United States Patent 11,098,302 (IDENTIFICATION OF POLYNUCLEOTIDES ASSOCIATED WITH A SAMPLE) - sequence listing, part 106

SEQ ID NO: 364156 - DNA, 601 bp, Homo sapiens
  misc_feature: GZ8MTXP01C5D7X.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctccaacatcggagacatcctgtgagctggtaacccaacaccctacccgaacggaacccggccccaaactcctacactctaatacagtacttacgtaaaggacggccccgagacgggggtcccagactccgatttcgcgtggcctaccgaggtctggccacctcacgccctcctgtccatcagtcgaccgtccggtctggagactggagctagtacttacgttagttgttacaggtagtggtacttacgacgtcctactagtcgtccgtcgggtcgttcgggttccgggacgggtaacgggaacccttaaacgttcggttacccgttcgttacggtccgacgacccgaacggtcccgttcccggtcccccg

SEQ ID NO: 364157 - DNA, 571 bp, Homo sapiens
  misc_feature: GZ8MTXP01DWWAQ.4.6.A06.1.454.CMB.2.raw
  modified_base (199)..(199): a, c, t, g, unknown or other
  modified_base (234)..(234): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggccccccggnagaggtcatcctctcttgtctggagcagctccaanatcggagacatctgtgagctggtaccaacaccctcccaggaacccgcccccaaatccctcatctatacagtacttctaaagacggcccgagacgggggtcccagactccgattctcgtggcctccaggtcctaggccctacctcacgtcctcctgtcccatcagtcggtactcccggtctggaggatgaggtctagtacttacgtatttgttacaggatgggtattacgacgtcctacatgcgtcggcttgggttccgggacggtaaacgggaccaaacgttcggttaaccgtgtttaacggtcgtacggcccaagggtcccttaaccggtcccccg

SEQ ID NO: 364158 - DNA, 620 bp, Homo sapiens
  misc_feature: GZ8MTXP01AXCOS.4.6.A06.1.454.CMB.2.raw
  modified_base (200)..(200): a, c, t, g, unknown or other
  modified_base (238)..(238): a, c, t, g, unknown or other
  modified_base (337)..(337): a, c, t, g, unknown or other
  modified_base (363)..(363): a, c, t, g, unknown or other
  modified_base (380)..(380): a, c, t, g, unknown or other
  modified_base (423)..(423): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggaggcagctccaanatcggagacatcctgtgagctggtacccaacaccctcccgaacggaacccggccccccaaatccctacactctaatacagtatttcgaacggcggcccncgacgggtcccagactccgtattcgngtcggctaccgagttcnggccacctcacgccctcctgcccatcgagtcggacctccggtnaggaggtctagggacgtcgtacgtaacttacgttagtttggttacgaggggttactagggtaatttaccgacgttacctaaacgtgtccggtcgttgggtccttaggggttaccgggcggggaaacggtaacccttaaacggttcgacccggttcgttacgggcaccgacccggaaggtcccttaacccggtccccg

SEQ ID NO: 364159 - DNA, 710 bp, Homo sapiens
  misc_feature: GZ8MTXP01A99EO.4.6.A06.1.454.CMB.2.raw
  modified_base (202)..(202): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagccgtcgtcggggccccccggnaggagggtcactcctctcttgttctggaggcagctccaacatcggagacatcctgtgagctcggtaacccaacaccctacccgaaggaaccccggcccccaaatccctacaacttccgtaatacagtactttacgaaacgacggccccgagtacgggggtcccagtactccgtactttcgcgtcggcccttaccgaggttcctcgggccctacccgttccgacgtccccttcccgtcgtacccattcgaaggtcggaaccgttccgggtcgtaggaacggtacgtggaacggtccgtaggtaccgttaacttaggtttacggttaccgaagggtaacgttgggggtaactttacgacgggtacccttaaccggtacgttccggtccggtccggttcgttcggggttacccgggacgggtaaaccgggtaaacccttaaaccggttcggttaccgttaaccgtacggtaaccgaccggaccccgttacggtcccgttcccggtcccccg

SEQ ID NO: 364160 - DNA, 649 bp, Homo sapiens
  misc_feature: GZ8MTXP01EFGHA.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtccgtcggggcccccggnagagggtcatcctctcttgttctggagcagctaccaacagtcggagacatcctgtgagctacggtaccaaccaccctcccgaacggaaccccgacccccaaactcctacactacctataaccagtacttacgaaacgacggccccgacgacgggtcccagtactcccgattctcgtcgcctaccgaggtcctggccctaccctcacgtcccctccctcgtccatcgacggtgaccgttccggtactggagtacgtaggacgtctagtaaccttacggttagtttgttacgaaggtagttaggtaacttacgacgtacctatagttcgccgttcgggtcgtttagggttccgggacgggtaaccggtaaacccaacggttccgttaaacccggtttcgttaaacggtccgaccggtaccccgacggtccccgttcccggtaaccccccg

SEQ ID NO: 364161 - DNA, 707 bp, Homo sapiens
  misc_feature: GZ8MTXP01DJGLH.4.6.A06.1.454.CMB.2.raw
  modified_base (200)..(200): a, c, t, g, unknown or other
  modified_base (340)..(340): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctaccaacatcggagacatcctgtgagctggtaacccaacaccctcccgaacggaacccggacccccaaactccctcactctaactacagattactaaggacggccccgngacggggtcccagactccgattctcgtacggcctccgaggtccgtggccctaccctcgaccgtccccttcccgtcgtccctacgtccgtaacggtcggtaccgttcccgggttaccgtagggtacgggtagtacgggtacgggtcttacggtaacctttaacggtttagtttcggttaaccgtagggtaagttcggggtaactttaccgacggtaccctagtacgtcggtccgttcgggtcgttggggtttaccggggacggggttaaaccgggaacccttaaaaccgggttcgttaaacccgggtttcgtttaaccgggtcgaacccggacccgttaacgggtccccgttcccggttcccccccgg

SEQ ID NO: 364162 - DNA, 707 bp, Homo sapiens
  misc_feature: GZ8MTXP01B3WCN.4.6.A06.1.454.CMB.2.raw
  modified_base (179)..(179): a, c, t, g, unknown or other
  modified_base (200)..(200): a, c, t, g, unknown or other
  modified_base (238)..(238): a, c, t, g, unknown or other
  modified_base (587)..(587): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctnagcgtcgtcggggcccccggnaggaggtcattcctctcttgttctggagcagctccaantcggagcatcctgtgagctcggtaacccaacacccgtaccccgaaacgggaaccccggacccccctaaaactcccctacaacttcctaataccaagtaactttctaaaacgggcggcccccggtcgaaccgggggtcccaaggtacttccggtactttcgtcgtcggcttacccgacggttccgtacgggcctacccgttaccacggccccttacccgtcgtacccattccgagggtccggtaaccgttccgggttacgtaggacggtagtcggaacgcttacggtaaccttacggtttaagtttcggtttacgaagggttacgtagggttaacttacgacgtccctanacgtcgtcgtcggtcgttcgggttaccgggcggtaaacgggtaacccttaaacgttccgttaccggtttaacgtacgggtcgtacccggaccgttaccggtcccgttaaccgtccccccg

SEQ ID NO: 364163 - DNA, 653 bp, Homo sapiens
  misc_feature: GZ8MTXP01E10ZE.4.6.A06.1.454.CMB.2.raw
  modified_base (200)..(200): a, c, t, g, unknown or other
  modified_base (458)..(458): a, c, t, g, unknown or other
tcagagcactgtagcacgaccggtgctcgatttagatctactgacagggggcttcagctgtgggtagagaagacaggactcaggacaatctccagcatggccagcttccctctcctcctcacccccctcactcactgtgcagggtcctgggcccagtctgtcctgactcaggcaccctcagcgtcgtcggggcccccggnagaggtcatcctctcttgtctggaggcagctccaacatcgggagacatcctgtgagctacggtaccaacaccctacccgaacggaaccccgacccccaaactccctcatactatacagtacttacgtaagacgggcccgacgacggggtcccaggtactcgtacttcgtcgtcggtcctccgaacggttctcggcctaaccctccacgtcccctcccctgtcccactctaggtcggaccgtccggtctaggacgtagnggaggctcgtaactacgttagtttcggttacgaggtagtacgggtaattaaccgagtacccctaagtacgttcggccgttccgggtcgttcggggtttccggggacggggttaacgggaacccgtaaacgttcggttaccgttacgttaacggactaaccggcccgacggttcccgtccggttccccccgtccgg

SEQ ID NO: 364164 - DNA, 728 bp, Homo sapiens
  misc_feature: GZ8MTXP01EVAAZ.4.6.A06.1.454.CMB.2.raw
  modified_base (203)..(203): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtccgtcggggccccccggnaggagggtcatcctcttcttgttcgtggagcagcctaccaacagtcggaagacactccgtgtagagctacggtaacccaaccaccctacccgaacggaaccccgaccccctaaactccctacatactaactacaagtacttacgaaacggacggtcccgacggaccggggtacccagtactaccgtattcgtcgtcgccctaacccgaggtccgacggaccctaccctccgtaaccgtccccttcccgttcgtacccagttccgtacggtcggtacccgttccggttacgtagggtacggtagttacggacggttccgttaaggtaaccctttaaggttacgtttacggttaaccgtagggttaacgttacggggttaactttaaccgacggtaccccttaagtcgttcggtcggttccgggtgttccggggttaccgggaacgggtacggaaacccttaaacgttcggttaacccggttgttacgaaccgacggacccgttaacgtcccgttccccgtccccgg

SEQ ID NO: 364165 - DNA, 683 bp, Homo sapiens
  misc_feature: GZ8MTXP01BPQ4H.4.6.A06.1.454.CMB.2.raw
  modified_base (201)..(201): a, c, t, g, unknown or other
  modified_base (241)..(241): a, c, t, g, unknown or other
  modified_base (439)..(439): a, c, t, g, unknown or other
  modified_base (478)..(478): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccccggnaggagggtcatcctctcttgttctggaggcagctccaacntctagaggactatcctgtgacgctacggtaacccaaacctacccgtaccccgaaacggaaaccccggaccccccaaaacttccctacaactttacctaactaacacgtaatttacctaaaaggccggacccgacgaacgggggtccccaagtactccggtattccgtcgtggaccctcgaaggtctcgggccaccctnacgccctcctgtccatcgagtcgacttccggctgacgtntcggaagtctaggacttacgttagtttaccggttagaaggtaggttacgggtaacttaaccgacggtaacccttacgaacgttcggaacctccgggttcggtttcgggttccggggaacgggtaccggttaaaaccgttacgttacggtaacccgttaggttaaccggtccgaccggacccgtaacggttcccgttaacccccgg

SEQ ID NO: 364166 - DNA, 619 bp, Homo sapiens
  misc_feature: GZ8MTXP01BG30F.4.6.A06.1.454.CMB.2.raw
  modified_base (199)..(199): a, c, t, g, unknown or other
  modified_base (335)..(335): a, c, t, g, unknown or other
  modified_base (450)..(450): a, c, t, g, unknown or other
  modified_base (588)..(588): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcgggcccccggnagagggtcatcctctcttgttctggaggcagctccaacagtcggagacatcctgtgagctaggtacccaacaccctacccgacggaaacccggcccccaaactcctcactctaatacagtattctaagcggcccgngacgggggtccccagactccgatttcctcgtcggcctaccgaggttctcgggcctaccctcacgtccctccctgtccctaatccgaggtcggtaccttccggtactaggacggtnttaggacgtctaggtaccttagttagtttgtacgagggtatgggtattacgacgtacctagtagtcgtccgtcggtgttcgggttccggggacggtaccggaaccttaaacgttcggttacccgttgttacggtaacnccggtacccgacggtccgttcccgtccccgg

SEQ ID NO: 364167 - DNA, 796 bp, Homo sapiens
  misc_feature: GZ8MTXP01AW8CL.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnaggagggtcatcctctcttgttctggaggcagctaccaacatcgggaggacatcctgtgagcgtacggtaacccaaccaccctacccgaacggaaccccggaccccccaaaactccctacattacctaataaccagtaactttacgtaaacgggaccgggtccccgacggacgggggttaccccaaggtacttcccggtaactttccgtcgtacgggtcccttaacccgacgggttcctacgggccctacccgtccacgtcccccttcccgtacgtacccagttccgagggtccggtaccgttcccgggtaccgttagggaacggtacgttacgggaacggtccgttaacgtaaacccgtttaacggtttacgttttacgggttaccggtaagggggttaacggttacgggggtaaacttttaaccggaaccggttacccctaaacgtacgttcggtaccgttccggggtaccgtttcggggttaccggggaccggggtaaacggggtaacccttaaaccggttcgggttacccggttcgttacgggtaaccaacccgggaccccgaacgggtccccgttaacccggtccccccgg

SEQ ID NO: 364168 - DNA, 628 bp, Homo sapiens
  misc_feature: GZ8MTXP01BBZAP.4.6.A06.1.454.CMB.2.raw
  modified_base (179)..(179): a, c, t, g, unknown or other
  modified_base (201)..(201): a, c, t, g, unknown or other
  modified_base (237)..(237): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctnagcgtcgtcggggccccccggnagagggtcatcctctcttgttctggagcagctcaantcggagacatcctgtgagctacggtaccaaccacctcccgaacggaaccccgcccccaaactccacatctatacagtacttacaacggcggccgacgacgggtcccagtactcgtattcgtctggcctaccgaggtctcggccaccgtcacgtcccctccgtcgtcctactcgacgtcggtacctccggtacgtcggagtagtaggacgtctagtaccttagttacgtttacggttacgaggtagttacgggtaacttacgaacgtcctaacgacgttcgtcgtaaccggtcgttccgggttccgggacggggaacgtaaccgttaacgttcggttaccggtcgttacgggtctaacggacccgttaacggtccgttaacccggtcccccg

SEQ ID NO: 364169 - DNA, 711 bp, Homo sapiens
  misc_feature: GZ8MTXP01A9F9K.4.6.A06.1.454.CMB.2.raw
  modified_base (200)..(200): a, c, t, g, unknown or other
  modified_base (578)..(578): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctccaacagtcggacgacactccgtgtgagctacggtaacccaacaccctcccgaacggaaccccggcccccaaactccctctactctaactacagtacttacgtaaacggaccggtcccgacggtacggggtccccaaggacttcccggtactttcgtccgtcggcccttaccgacgggttctcgggacctacccgtccgaacgtccccttccgtcgtccctaagtccgaggttcggtaccgttcgggtcctaggtacggagtggaacggtctacgtaaccttagtttacgtttcggttaccgaagggtagtacggggtaactttaccgaacggttcctaaacgttntccgggtcgttaaccgggctttcgggggtccgggaccgggaaacgggaaacccttaaacgggttcggttaacccggtttaacgttacggccggaaccgcccggttaacggtcccgttaaccccgggtcccccg

SEQ ID NO: 364170 - DNA, 601 bp, Homo sapiens
  misc_feature: GZ8MTXP01BE93Y.4.6.A06.1.454.CMB.2.raw
  modified_base (222)..(222): a, c, t, g, unknown or other
  modified_base (237)..(237): a, c, t, g, unknown or other
  modified_base (315)..(315): a, c, t, g, unknown or other
  modified_base (322)..(322): a, c, t, g, unknown or other
  modified_base (583)..(583): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccgagggaagggactggaatggattgggaacacctattacagtgggagcccagctacaactccctcctcaagngtcgactcaccatcncggctgacccgtcaagatcagttcctccctgaggctgacctcgtgtcgaccgccgctcgacacggccgtctattacgngtggganacagtgcgagtggtgttcgcgccccccgagtcgtggggccgagtaaacttcgttggcctaccgtctcctcacgccctaccaccgacggccctacgtccggtcccttccccgtcggccctcccgtcgccctaccgacgggaccgacctacccggtacggacgcgacccgacgaccggcccgggtcccgtggggcctcggccgttcggacaacggtccttaccgtttacccagtacgttcgaccgttgcggaaggcgggtcgnggcgaagggtccaagaag

SEQ ID NO: 364171 - DNA, 685 bp, Homo sapiens
  misc_feature: GZ8MTXP01B565J.4.6.A06.1.454.CMB.2.raw
  modified_base (201)..(201): a, c, t, g, unknown or other
  modified_base (241)..(241): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagaggtcatcctctcttgttcgtggagcagcctaccaacngtcgggagacatccgtgtgacgctacggtaacccaaccgaccctacccgaacggaacccgacccccaaactcctacatactaatacagtacttacaacggcgcccgagacgggtccagtctccgattcgcgtcggccttaccgaggtcgtggaccctaccctcaccgtcccctccgtcgtaccctagtccgtaacggtcggtaacccgttccgggttacgagggaggtacgtcgggaacgtcgttacgtaacccgtttagttacgttttacgggttacgaagggttagttacgggtaaactttacgaacgtccttacgtagtcggtccgtcgggtcgtttcggggttaccgggacgggtaaacggtaacccttaaacgttcggaacccgtttcggtaacggtccgaaccggacccgttaacggtcccgttaacccggtcccccg

SEQ ID NO: 364172 - DNA, 766 bp, Homo sapiens
  misc_feature: GZ8MTXP01DYPHV.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnaggagggtcattcctcttcttgttcgtggaggcagcctaccaacagtcgggagactatcctggtgacgctacggtaacccaaccaccctacccgaacggaaccccggaccccccaaactccctactactactaactaacagtaactttacgtaaacggacggtccccggacgaccgggggtccccaagtactcccggtactttctcgtcggtcccttaccgaggtcgtcggaccctaacccgtccaccggtcccccttcccgttacgtacccctaagttccgtaacgggtcgggtaacccctttcccgggttaccgttagggaacggtaacgttcggggaaacgggttccttacgggttaaacccttttacggttaagttttcggtaccgtaagggtagtttacggggtaactttacggacgtacccttaatacgttcggtccgttaacgggttcgttcggggttaccggggaccgggaaacgggtaacccttaaacggttcggttaaccccgtttcggttacgtaaccgacccgaccgacggtccccgttcccgtaaccccccg

SEQ ID NO: 364173 - DNA, 648 bp, Homo sapiens
  misc_feature: GZ8MTXP01ENK5J.4.6.A06.1.454.CMB.2.raw
  modified_base (200)..(200): a, c, t, g, unknown or other
  modified_base (235)..(235): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagaggtcatcctctcttgtctggagcagctccaanatcggaggacactcctggtgagctcggtaacccactaccctcccgaacggaacccggacccccaaactcctacactactatacaagtacttacgtaacggacggcccggacgacggggtacccagactcccgatttctcgtcggcctacccgaggttcgtcggcctacccgtccaccgtcccctccgttcgtaccctaagtccgaggttcgtaccgttcccggtacggtagagggtagtacgagggtcttagtacgttaactttagtttagttcgaaggtgtaggggtacttacgacgtaccgtactagttacggccgtcggtcgttaggttccggacggtacggaacccttaaacgttcgttacccggttgtaacggttccgacggcccttaacggtccgttcccgtccccg

SEQ ID NO: 364174 - DNA, 663 bp, Homo sapiens
  misc_feature: GZ8MTXP01COG62.4.6.A06.1.454.CMB.2.raw
  modified_base (201)..(201): a, c, t, g, unknown or other
  modified_base (240)..(240): a, c, t, g, unknown or other
  modified_base (259)..(259): a, c, t, g, unknown or other
  modified_base (272)..(272): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagagggtcatcctctcttgttctggagcagctaccaacntcggagacatcctgtgacnctacgtaccaacnccctacccgacggaacccgacccccaaactccctacactctaataccagtacttacgaacggacggccccgagacgggggtcccagtactcccggatttcacgtggccctaccgtaggtcctcgggccacccgttcgaccgtccccttaccccgcgttacccagttccgacggttcggaccgttcccggtacgttcggaggtacttggacgtctagtaaccttacgtttagtttcggttacgaaggttacgtcgggtaactttaccgacggtccctaagtcgtcgtccgtcggtcgttcgggttcgggaccgggtaaacgggaccttaaacgttcgttacccgttaacgtacggtcgaccggtcccgaacggtcccgttaaccgtcccccg

SEQ ID NO: 364175 - DNA, 661 bp, Homo sapiens
  misc_feature: GZ8MTXP01CEYEH.4.6.A06.1.454.CMB.2.raw
  modified_base (178)..(178): a, c, t, g, unknown or other
  modified_base (197)..(197): a, c, t, g, unknown or other
  modified_base (212)..(212): a, c, t, g, unknown or other
  modified_base (219)..(219): a, c, t, g, unknown or other
  modified_base (226)..(226): a, c, t, g, unknown or other
  modified_base (232)..(232): a, c, t, g, unknown or other
  modified_base (242)..(242): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcacctnagcgtctggggcccccggnaggaggtcatctctnttgtcgnggagcancacaangtcggagacntctgtgacgactacgaaccaactaccctaccgaacggaacccgaccccaactcctacactactaataacagtaacttacgaaacggcggccgacggacgggtaccagtactccgtacttcgtcgtcggtacctaccgtacggtccgtcggaccctacccgtacgaccgtccccttcctacgtaccctacgtacgtacggtacggtaccgttcccggttacgtacgggacggacgtcggacggtactacgtaactttaacgttagtttacggtacggtaaggtacggtacgtaacttaccgaacgtacctaacgtatcgtcgtcggtcgttcgggtaccgggacgggaaacggtaaccttaaacggttcgttaccgttaacgtaacggtcacggtacccggacgtccgttcccgtccccg

SEQ ID NO: 364176 - DNA, 565 bp, Homo sapiens
  misc_feature: GZ8MTXP02I90A5.4.6.A06.1.454.CMB.2.raw
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagcccagctacaatccctcctcaagagtcgactcaccatctcggctgacccgtccaagatcagttctccctgagctgacctctgtgaccgccgctgacacggccgtctattactgtgggagacagtgcagtggtggtcgtgcccccccgagtacgtggggccgcggaatcttgggtcaccggtctcctcagcctccaccaacgggcccatcggtccttcccccgtggccgccctcgcctccgacggacgccaccctccggagacgcacacgccggcccgtggggcctcgcccgtggtccaacgggtacctaccgttcccctaacacgtcgccttccgtgaacggccgggctcgggacgaacgggcgacgag

SEQ ID NO: 364177 - DNA, 508 bp, Homo sapiens
  misc_feature: GZ8MTXP02GBT2E.4.6.A06.1.454.CMB.2.raw
  modified_base (321)..(321): a, c, t, g, unknown or other
  modified_base (343)..(343): a, c, t, g, unknown or other
tcagagcactgtagcacgaccggtgctcgatttagatctactgacaggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctccaacatcggaggacatcctgtgagctggtaccaacacctcccaggaaccgcccccaaatcctcatctatacagattctaaagaggcccgnaaggggtcccagatccgattcnctggctccaggtctggcacctcagcctcctgtccatcagtgactccgtctgagatgagctgactactattgttcaggatgggattacagctacatgctcggctggttcggcggagggaccaaaacgtcgaccgtcgttaaggtcagcccgaaaggcctgcccccg

SEQ ID NO: 364178 - DNA, 603 bp, Homo sapiens
  misc_feature: GZ8MTXP02I7TCI.4.6.A06.1.454.CMB.2.raw
  modified_base (361)..(361): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtcaagaatcagttctccctgaggctgacctctgtgaccgccgctgacacggccgtctattactggtgggagacagtgcagtggtggtcgtgcccccccgagtacgtggggccncggtaattttcgggccaccgttctccctcacgccctccaccgaacgggcccatccggtccttcccccgtggccgcccctgcctccgaggacgccacccgtccgagacgccacgacggccggcccgtggggcctcggcccgtgggtaccaacgggtacccttaccgtttcccctaacgtacggttccggtccttccggtcggacggccggggcttcggggaccgaaacgggccgaccgagtag

SEQ ID NO: 364179 - DNA, 533 bp, Homo sapiens
  misc_feature: GZ8MTXP02IMBQ3.4.6.A06.1.454.CMB.2.raw
  modified_base (198)..(198): a, c, t, g, unknown or other
  modified_base (236)..(236): a, c, t, g, unknown or other
  modified_base (293)..(293): a, c, t, g, unknown or other
  modified_base (321)..(321): a, c, t, g, unknown or other
  modified_base (399)..(399): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggnagagggtcatcctctcttgttctggagcagctccaacntcggaggacatcctgtgagctggtaccaacacctcccaggaaccgcccccaaatccncatctatacagattctaagacggcccgnacggggtccccagactccgattctctggctccagtctggcacctcacgcctcctgtccatcagtgactccgtctgagntcgaggctgactactatttgttacagggatcgggattacgagtcctacatgctcggcttggttcggcggaacgggacctaaaacgtcgaaccgttaacgttacggtcacgtacccaacggtcctacgtcccccg

SEQ ID NO: 364180 - DNA, 562 bp, Homo sapiens
  misc_feature: GZ8MTXP02I6R24.4.6.A06.1.454.CMB.2.raw
  modified_base (198)..(198): a, c, t, g, unknown or other
  modified_base (401)..(401): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctaggcccagtctgtcctgactcaggcaccctcagcgtctggggcccccggnagagggtcatcctctcttgtctggagcagctccacatcggagacatcctgtgagctggtaccaacacctcccaggaaccgcccccaaatccctcatctatacagattcaagacggccccgcacggggtccccaaggactccgattcctctcggctccaggtctggccacctcagccctccctgtccatcagtggactcggtcngagatgagctgactactatttgtcaggtatgggatttacagtacctacagtcgctcgggcttcgggttcggacggggtaacgggtacccaaaacgttcggaaccccggttcgttaacgggttccaacggccccaaaggggtcccttaccggtcccccccgg

SEQ ID NO: 364181 - DNA, 517 bp, Homo sapiens
  misc_feature: GZ8MTXP02HLIQB.4.6.A06.1.454.CMB.2.raw
  modified_base (199)..(199): a, c, t, g, unknown or other
  modified_base (318)..(318): a, c, t, g, unknown or other
  modified_base (339)..(339): a, c, t, g, unknown or other
  modified_base (370)..(370): a, c, t, g, unknown or other
  modified_base (386)..(386): a, c, t, g, unknown or other
  modified_base (456)..(456): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctgggggcccccggnagagggtcatcctctcttgttctggagcagctccaacatcggagacatcctgtgagctggtaccaacaccctcccaggaaccgcccccaaatcctcatcatacagattcaagcggcccnaggggtcccagatccgattcnctgctccaggtctgcacctcacgccctcctnccatcagtgactcgtntgagatgagctgacttactatttgtcaggatgggtattacagcctacatgcgtcggcttggttaccgggnggtacgggacctaaacgtcgaccgttgttacggtacacgacccgaacggccttcgcccccg

SEQ ID NO: 364182 - DNA, 630 bp, Homo sapiens
  misc_feature: GZ8MTXP02JXO8H.4.6.A06.1.454.CMB.2.raw
  modified_base (319)..(319): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagccccagggaagggactggaatggattgggaacacctattacagtgggagccccagctacaactccctcctcaagagtcgactcaccatctcggctgacccgtcaagaatcagttctccctgaggctgacctctgtcgaccgccgctgacacggccgtctattactggtggganacagtgcgaggtggtggttcgtcgccccccgtagtacgtcggggccgcggaacttcgttcgggtccaccggttctcccgtcacgccctaccaccgaacgggcccacgttccggtccttcccccgtggcccgcccgtcgcctccgacggacgccgaccgtccggagacgccgaccgacggtcccggcccgtcgggcctcggcccgtcgggtaccgtaaacgggtacccttaccttaccccgtaacgtacggtcgtccgttcgtcgggaacgggccggggtacgtcggggaccgaacggggccggactaacgg

SEQ ID NO: 364183 - DNA, 583 bp, Homo sapiens
  misc_feature: GZ8MTXP02JDBX0.4.6.A06.1.454.CMB.2.raw
  modified_base (321)..(321): a, c, t, g, unknown or other
  modified_base (343)..(343): a, c, t, g, unknown or other
  modified_base (469)..(469): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctccaacatcggaggacatcctgtgagctggtaccaacacctccaggaaccgcccccaaactcctcatctatacagattcgtaaggggcccngaggggtcccagatcgacttcnctggcctcgacggtctcgggccaccctcacgccctccctgtcccatcagttcggactccggtctgacgatggaggctgaaccttattagttgttacagggtagtagggtattacacgtcctaactntcgtcgtcggtcgttggttcggggacggtaaacgggaacctaaacgtcggacccgtttacgtaacgggtaccgaacggtaccccaaaggggtcccttacggccccccgttacgg

SEQ ID NO: 364184 - DNA, 550 bp, Homo sapiens
  misc_feature: GZ8MTXP02JNL16.4.6.A06.1.454.CMB.2.raw
  modified_base (316)..(316): a, c, t, g, unknown or other
  modified_base (357)..(357): a, c, t, g, unknown or other
  modified_base (379)..(379): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaaggactggaatggattgggaacacctattacagtgggagccccagctacaatccctcctcaagagtcgactcaccatctcggctgacccgtccaagaatcagttctccctgaggctgacctctgtgaccgccgctgacacggccgtctattactgtgganacagtgcagtggtgttcgtgccccccgagtacgtggggccnggaatcttggcaccgtctcctnacgcctccaccacgggcccacgtcggtcttcccccgtgccgccctcgcctccacggacgccacctccgagacgccgacacgccggcccgtgggcctcgccgtggtccgaaacggtacctaccgttccctacgacgtcgctcgtgaacgcgggcgtcggcaacggcgacgag

SEQ ID NO: 364185 - DNA, 555 bp, Homo sapiens
  misc_feature: GZ8MTXP02JHDZA.4.6.A06.1.454.CMB.2.raw
  modified_base (392)..(392): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggcccccggcagagggtcatcctctcttgttctggagcagctccaacatcggagacatcctgtgagctggtaccaacaccctcccgaaggaaccgacccccaaactccctcactctaataccagtattactaagacggccccgacgacggggtccccaggactccgattctctggctccgaggtctggcacctcagccctccngtccatcagtcgactccggtctggagactgagctagactactattgtcaggtatgggattacgagtcctagatcgcgtcggtcttcggttcggcgggaacggaccctaaaacgtcgtacccgtcgtttaacggcacggacccgaaggtccttaccgtcccccg

SEQ ID NO: 364186 - DNA, 534 bp, Homo sapiens
  misc_feature: GZ8MTXP02FR7GH.4.6.A06.1.454.CMB.2.raw
  modified_base (421)..(421): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagccccagggaagggactggaatggattgggaacacctattacagtgggagccccagctacaatccctccctcaagagtcgactcaccatctcggctgacccgtccaagaatcagttctccctgaggctgacctctgtgaccgccgctgacacggccgtctattactgtggagacagtgcagtggtggttcgtgccccccgagtactggggccgcggaatcgtggtcaccgtctcctcagcctcaccaggcccatcggtcttccccctgccgtcccncgctccaggacgcacctccgacgagccacgacgcggtcccgcgggctcgcctgggtcaaacggtctaccttccctacacgtcgctcgtgaacggcggcgtcggcaggcgctag

SEQ ID NO: 364187 - DNA, 547 bp, Homo sapiens
  misc_feature: GZ8MTXP02J0PUW.4.6.A06.1.454.CMB.2.raw
  modified_base (199)..(199): a, c, t, g, unknown or other
  modified_base (367)..(367): a, c, t, g, unknown or other
  modified_base (456)..(456): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggccccccggnagagggtcatcctctcttgttctggaggcagctcaacatcggagacatcctgtgagctggtaccaacacctcccaggaaccgcccccaaactcctcatctatacagattctaagacggcccgcgacggggtcccagatccgattctctgctccgaggtctggcacctnacgccctccctgtcccatccagtcggacctcccgggtctggacggatgaggctggacttactattgttacgagggtagtgggattacgngtcctacatcgctcggctgggttcggacgggtaacggaccaaacgtcgtaccgtcgttaacggtcacggacccgaggcctccggtcccccg

SEQ ID NO: 364188 - DNA, 585 bp, Homo sapiens
  misc_feature: GZ8MTXP02GBYPM.4.6.A06.1.454.CMB.2.raw
  modified_base (319)..(319): a, c, t, g, unknown or other
  modified_base (361)..(361): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctcctcaagagtcgactcaccatctcggctgacccgtccaagaatcagttctccctgaggctgacctctgtgacccgccgctgacacggccgtctattactgtggganacagtgcagtggtggttcgtgccccccgagtacgtggggccncggaattcgttgggtccaccgtctcctcacgccctccaccaacgggcccagtccggtccttcccccgtggcccgccctcgcctccgaggacgccaccgtccgagacgcacacgccggcccgtggggcctggcccgtgggtacccaaacgggtaccttaccgttcccctaacgacgttcgccttcgtcggaacggccggggcgtcgggacgaacgggccgacacg

SEQ ID NO: 364189 - DNA, 679 bp, Homo sapiens
  misc_feature: GZ8MTXP02ICD00.4.6.A06.1.454.CMB.2.raw
  modified_base (240)..(240): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccgggcagagggtcatcctctcttgttctggaggcagctccaacntcggaggacatcctgtgagctggtaccaacaccctcccaggaaccgccccccaaactcctcatctataaccagtacttctaaagacggcccgcgacggggtccccagatccgattctcgtggctccgagtctggccacctcacgtccctccttcgccctatcagtcggacctcccggtctggacggatgggacgctagtacttaccttagtttgttacgagggtattggggtaactttacgacggtacccttaagtacgtttcggacccgtttcggggtccctttagggggtttcccggggtaccgggggaaaaccgggggttaaaccccaaaaaccgggtttccggtaaaaccccgggtttcggttttaaaaccgggtaccggaaccggaacccccccggtaaaggggtaccccgtttaccccgggtcccccccccgg

SEQ ID NO: 364190 - DNA, 560 bp, Homo sapiens
  misc_feature: GZ8MTXP02JJ5A0.4.6.A06.1.454.CMB.2.raw
  modified_base (199)..(199): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggcccccggnagagggtcatcctctcttgttctggaggcagctccaacagtcggagacatcctgtgagctggtaccaacacctcccgaggaaccgcccccaaatcctcactctatacagtacttctaaagacggcccgcgacggggtcccagatccgattctctggctccgaggtctggcacctcacgcctcctgtccatcagtcgactccgtctgagatgagtctagactactattgtacgaggtatgggacttacgacgtacctagtacgtgcgtcggtcttgggttccggacgggaacgggtaccaaaacgtcggaacccgttcgttaacgggtaccacggacccgtaacgggcctaccggtcccccg

SEQ ID NO: 364191 - DNA, 588 bp, Homo sapiens
  misc_feature: GZ8MTXP02IMAOS.4.6.A06.1.454.CMB.2.raw
  modified_base (264)..(264): a, c, t, g, unknown or other
  modified_base (322)..(322): a, c, t, g, unknown or other
  modified_base (342)..(342): a, c, t, g, unknown or other
  modified_base (364)..(364): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaactccctccctcaagagtcgactcaccatctcggctgacccgtcaagaatcagttcncctgagctgacctctgtcgaccgccgctgaccaccggccgttctattactggtggganacagtgcaggtggtggtcgngccccccgagtacgtggggccnggattcgtggtcaccgtctcctcgacgccctccaccgaacggcccacgtccggtcccttcccccgtcggcccgtcccgtcgcctaccgacggacgcccaccgtccggagacgcaaccgcgcccggcccgtcgggcctcggccgtcggtaccgaacggtaccttaccgttccctaacgacgttcgcttcgtggaacggcgggcgtcgggacgaacggcgacgaag

SEQ ID NO: 364192 - DNA, 610 bp, Homo sapiens
  misc_feature: GZ8MTXP02FXI5F.4.6.A06.1.454.CMB.2.raw
  modified_base (200)..(200): a, c, t, g, unknown or other
  modified_base (377)..(377): a, c, t, g, unknown or other
  modified_base (450)..(450): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctccaacatcggaggacatcctgtgagctcggtaccaacaccctacccgaacggaacccgaccccccaaactccctacactcctaataccagtactttacaaacggacggccccgacgacggggtccccaagactcccgtatttccncgtcggcctcccgaggttccgtcggcctacctcacgtccctcctcgtccatcagtcgactccggtctgacggntgacggctagacttacttagtttgtcgagggtagtagggtattacgacgtctactagtcgcgtcggtcgttcggttcgggacggtaacgggaacctaaacgtcggtaaccgttcgttacggtaccgacggtacccgtaacggtcccgtcccgtcccccgg

SEQ ID NO: 364193 - DNA, 528 bp, Homo sapiens
  misc_feature: GZ8MTXP02GLNLC.4.6.A06.1.454.CMB.2.raw
  modified_base (316)..(316): a, c, t, g, unknown or other
  modified_base (355)..(355): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctccctcaagagtcgactcaccatctcggctgacccgtcaagatcagttctccctgaggctgacctctgtgaccgccgctgacacggccgtctattactgtggancagtgcagtgtggtcgtgccccccgagtactggggccgnggaatctgggtcaccgtctcctcagcctccaccgaacgggcccatccggtcttcccccgtggccgccctcgcctccaggacgccacctccgagacgcacacgcggccctgggctgcctggtcacggactacttccctacacgtcgctcgtgaagcggcgtcggcacggcgcag

SEQ ID NO: 364194 - DNA, 609 bp, Homo sapiens
  misc_feature: GZ8MTXP02HAMD3.4.6.A06.1.454.CMB.2.raw
  modified_base (434)..(434): a, c, t, g, unknown or other
  modified_base (508)..(508): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcgggggcccccggcagagggtcatcctctcttgttctggaggcagctccaacatcggaggacatcctgtgagctggtaccaaccacctaccccgaaggaacccggaccccccaaatccctacactcctaatacagtaacttactaaagacggcccgcgaggggtccccaagtactccgattctctggctcgagtctggcacctcacgtcccctccgtcgtccatccgagtcggaccgttcccggtntcggaggtatggacggtctaggtacttacttagtttgtacgagggtagtgggtacttaacgacgtacccttaanacgtcgtcgttcggtcgttacggtcggggacggtaacggaacctaacgtacggtaccgttaagtacgtaccgacgtaccgtacggtccgtacccgtccccg

SEQ ID NO: 364195 - DNA, 591 bp, Homo sapiens
  misc_feature: GZ8MTXP02I5PA9.4.6.A06.1.454.CMB.2.raw
  modified_base (294)..(294): a, c, t, g, unknown or other
  modified_base (408)..(408): a, c, t, g, unknown or other
  modified_base (413)..(413): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggccccccggcagagggtcatcctctcttgttctggagcagctcaacatcggagacatcctgtgagctggtaccaacaccctcccaggaaccgcccccaaatccncatcatacagtattctaaagacggcccacgacggggtccccaaggactccgattctctggctccgaggtctggccacctcacgtccctcctcgtccatcagtcgacctccggtntgagntggagctagacttactagtttgttcagggtactgggaactttacgacgtccctaagtatcggcgtcggtcgttcggttccggggacggtaacggggtaaccctaaaacggttcggtaacccggttcgttaaacggtccgaaccggaccccgtaacgggtccctacccggtccccccgg

SEQ ID NO: 364196 - DNA, 520 bp, Homo sapiens
  misc_feature: GZ8MTXP02G06RR.4.6.A06.1.454.CMB.2.raw
  modified_base (199)..(199): a, c, t, g, unknown or other
  modified_base (237)..(237): a, c, t, g, unknown or other
  modified_base (444)..(444): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggnagagggtcatcctctcttgttctggaggcagctccaanatcggagacatcctgtgagctggtaccaacacctcccaggaaccgcccccaaatcctcatctatacagattcaagcggcccgcgaggggtcccagatccgattctctggctccaggtctggcacctcacgccctcctgtccatcagtcgactccgtctcgagatgagctagactactattgttcgaggtagtggattacgagcctanatgctcggcgtgttcggcggtacggaccaaacgtcgaccgtcgttacggtcacgcccgaacggtcctcgtcccccg

SEQ ID NO: 364197 - DNA, 606 bp, Homo sapiens
  misc_feature: GZ8MTXP02G7GTB.4.6.A06.1.454.CMB.2.raw
  modified_base (261)..(261): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagccccagggaagggactggaatggattgggaacacctattacagtgggagcccagctacaactccctccctcaagagtcgactcaccatctcggctgacccgtcaagatcagttcnccctgagctgacctctgtcgacccgccgctcgaccacggccgtctattaccgtggtgggagacagtgcaggtggtggtcgtcgccccccgagtaccgtcggggccgcggtaattcgttgggtccaccggtctcctcacgccctaccaccgacggcccagtccgtcccttccccgtggcccgccctcgcctaccgacggacgccaccgtccgagacgaccacgacggccggccgtcgggctcggccgtagggtaccgaaacgggtacccttaccgttaccccgtacgtacggttcgccgttcgtacgggaacggtcggggacgtcgggaccgaacgggccgactag

SEQ ID NO: 364198 - DNA, 506 bp, Homo sapiens
  misc_feature: GZ8MTXP02FHFAJ.4.6.A06.1.454.CMB.2.raw
  modified_base (197)..(197): a, c, t, g, unknown or other
  modified_base (322)..(322): a, c, t, g, unknown or other
  modified_base (343)..(343): a, c, t, g, unknown or other
  modified_base (376)..(376): a, c, t, g, unknown or other
  modified_base (396)..(396): a, c, t, g, unknown or other
  modified_base (415)..(415): a, c, t, g, unknown or other
  modified_base (442)..(442): a, c, t, g, unknown or other
  modified_base (473)..(473): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctgggcccccggnagagggtcatcctctcttgttctggaggcagctccaacatcggagacatcctgtgagctggtacccaacaccctcccaggaaccggcccccaaatcctcatctatacagattcaaagcggcccgnaggggtcccagatccgattcnctggctccaggtcctggcacctcagcctccctntccatcagtgactccggtcngaggatgagctgactactnttgttcagggatgggattacagcctanatgctcggctgttcggcggagggaccaaacngaccgtgtaggtcagcccaaggcctcgcccccg

SEQ ID NO: 364199 - DNA, 622 bp, Homo sapiens
  misc_feature: GZ8MTXP02H0MUW.4.6.A06.1.454.CMB.2.raw
  modified_base (199)..(199): a, c, t, g, unknown or other
  modified_base (213)..(213): a, c, t, g, unknown or other
  modified_base (237)..(237): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggcccccggnagagggtcatcctntcttgttctggaggcagctccaanatcggagacatcctgtgagctaggtaccaacacctcccgaggaacccgcccccaaactcctacatctaataccagtattacgaagcggcccgcgacggggtccccagactccgatttccgtctcggtcctccgacggtcgtcggacctaccgtccacgtcccctcctagtcccatccgagttcggacccttccgggttctcggaaggtacgtaggacgtctagtaccttaacgttagtttcggttacagggtagtgggtaaacttacgtacggaccttacgagtcgtcgttcggcgtttacggttcgggcggaaacgggtaccaaaacgtccgtaaccgtaacgtttacggtaccacgtaccgaacggtccgtaccggtcccccg

SEQ ID NO: 364200 - DNA, 512 bp, Homo sapiens
  misc_feature: GZ8MTXP02FIT10.4.6.A06.1.454.CMB.2.raw
  modified_base (325)..(325): a, c, t, g, unknown or other
  modified_base (346)..(346): a, c, t, g, unknown or other
  modified_base (368)..(368): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtctgggcccccgggcagagggtcatcctctcttgttctggaggcagctccaacatcggaggacatcctgtgagctggtaccaacacctcccaggaaccggcccccaaaatccctcatctatacagattctaagaggccccgnaggggtccccagatcgattcnctggctccaggtctggcacctnagcctcctgtccatcagtggactccggtctgagatgaggctgactactattgttcaggatgggattacagtcctacatgctcggctgttcggcggaggtaccaaacgtgaccgtcttaaggcagcccaaggctcgccccctcgg

SEQ ID NO: 364201 - DNA, 761 bp, Homo sapiens
  misc_feature: GZ8MTXP02G7JR5.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggaggcagctccaacattggagacatcctgtgagctcggtaccaacaccctccccgaacggaaccgacccccccaaatccctacactcctaataccgagtactttacgaaagaccggcccgacgacggggtaccccaggactcccggtattcctcgtcgggtcttcccgagggttccttcggacctaacccgttcaccgtcccctttcccccgtagtacccctattcccgaagggttcggacccgtttcccggggttaccttcggggaacgggtaagttacgggaacgggtccttacgggtaacctttaacctttaggttttacggtttaccgaaggggtaacgttagggggttaacttaaccgtaacggtaccccctttaagtaacgttcggtcccggttaccgggtaccgtttcgggggtttaccggggaccggggaaaccggggtaaccctaaaaaccggtccggttaaacccggttaacgtttacgggtaaccgaccggtaccccgtaaacggccccgtaccgttcccccccgg

SEQ ID NO: 364202 - DNA, 545 bp, Homo sapiens
  misc_feature: GZ8MTXP02IURAA.4.6.A06.1.454.CMB.2.raw
  modified_base (199)..(199): a, c, t, g, unknown or other
  modified_base (384)..(384): a, c, t, g, unknown or other
tcagagcactgtagcacgaccggtgctcgatttagatctactgacagggggcttcagctgtgggtagagaagacaggactcaggacaatctccagcatggccagcttccctctcctcctcacccctcctcactcactgtgcagggtcctgggcccagtctgtcctgactcaggcaccctcagcgtctggggcccccggnagagggtcatcctctcttgttctggaggcagctccaacatcggaggacatcctgtgagctggtacccaacaccctccccaggaaccggccccccaaactcctcatctatacagattctaagacggcccgcgaggggtcccagactccgattctctgctccgagtctgccacctcacgcctccctntccgggatcagtcggactccgtctgagagtgagctgactactagttgttcgaggtagtggattacacgtacctagatgtcgtcggtcgttcggtcggtacggacggtaccgaaacgtgaccgttaacgtacgtacgacgaccgaacggccgtcgtcccccg

SEQ ID NO: 364203 - DNA, 562 bp, Homo sapiens
  misc_feature: GZ8MTXP02FU0GF.4.6.A06.1.454.CMB.2.raw
  modified_base (345)..(345): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggcccccggcagagggtcatcctctcttgtctggagcagctccaacatcggagacatctgtgagctggtaccaacacctcccaggaaccgccccaaactcctcatctatacagattctaaagacggcccgcgacggggtcccaggactccgattcnctggctccaggtctggccacctcacgccctccctgtccatcagtggacctccgtctggtaggactaggacgcgtagacttaacttagttagttacgaggtatggggtattacacggtacctatactgctcgggtcttggttccgggacgggtaacggaccaaaacgtcggaaccggtcgttacgggtcacggacccgtaacggccgtaccgcccccg

SEQ ID NO: 364204 - DNA, 619 bp, Homo sapiens
  misc_feature: GZ8MTXP02FOM5H.4.6.A06.1.454.CMB.2.raw
  modified_base (320)..(320): a, c, t, g, unknown or other
  modified_base (365)..(365): a, c, t, g, unknown or other
  modified_base (573)..(573): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtgggagccccagctacaatccctcctcaatagtcgactcaccatctcggctgacccgtccaagaatcagttctccctgaggctgacctctgtcgaccgccgctgaccacggccgtctattactgtggganacagtgcagtggtggttcgtgcccccccgagtaccgtggggccgnggaattcgttgggtccacccggttctaccctcgacgtccccttacccacccgaaacggggcccccaacgttcccgggttccctttccccccgtgggccccgtcccctcggcctcccgagggacgcccaacccgtcccggagacggccaccgacggccggcccgtggggcctcggcccgtgggtccaaacggtacctaccttcccctanacgtcgctcgtggaacggtcgggctcgggaccaacggccgacgaag

SEQ ID NO: 364205 - DNA, 517 bp, Homo sapiens
  misc_feature: GZ8MTXP02FVCYX.4.6.A06.1.454.CMB.2.raw
  modified_base (346)..(346): a, c, t, g, unknown or other
  modified_base (400)..(400): a, c, t, g, unknown or other
  modified_base (441)..(441): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggccccccggcagagggtcatcctctcttgttctggaggcagctccaacatcggaggacatcctgtgagctggtaccaacacctcccaggaaccgcccccaaactcctcatctatacagattcaagcggcccgcgacggggtcccagactccgattcnctggctccaggtctggcacctcagcctccctgtccatcagtgactcgtctgagntgagctgactactattgtcaggtatggattacgagtcctanagtgctcggcttggtcggcggacggacctaaacgtcgaccgtcgttacggtcacgcccgaaggcctaccgtccccg

SEQ ID NO: 364206 - DNA, 529 bp, Homo sapiens
  misc_feature: GZ8MTXP02FUUHY.4.6.A06.1.454.CMB.2.raw
  modified_base (236)..(236): a, c, t, g, unknown or other
  modified_base (250)..(250): a, c, t, g, unknown or other
  modified_base (314)..(314): a, c, t, g, unknown or other
  modified_base (342)..(342): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctccaanatcggagacatccngtgagctggtaccaacacctcccgaggaaccgcccccaaatcctcatctatacagacttcaagnggcccgcaggggtcccagatccgattcnctggctccgaggtctggcacctcagccctccctgtccatcagtcgactccggtctgagatgaggcttagactacttagttgttcaggatagggattacagtcctacatgctcggcttggtcggcggacggaccgtaaacgtggtaaccgtcgttacggtacacggcccgtaaggcctacgtcccccg

SEQ ID NO: 364207 - DNA, 612 bp, Homo sapiens
  misc_feature: GZ8MTXP02HB2A5.4.6.A06.1.454.CMB.2.raw
  modified_base (198)..(198): a, c, t, g, unknown or other
  modified_base (293)..(293): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggnagagggtcatcctctcttgttctggaggcagctccaacatcggagacatcctgtgagctggtaccaacacctcccaggaaccgccccaaactccncatctaatacagtacttctaaggacggccccgacgacgggggtccccaaggtactcccggatttcctcgtgggccttccgagggttctcgggcaccctcacgccctccctgtccatcagtcggactccggtctggaggactggacggctaggacttacttagttgttacgagggtacgtgggtaacttacgacggtacctacgtatcgccgtcgggtcttcgggttccgggacgggaacgggtaaccctaaaacggtcgtaacccggttcgtttaacggtaccgacggtacccgaaacggtcccgtaccgtccccccgg

SEQ ID NO: 364208 - DNA, 650 bp, Homo sapiens
  misc_feature: GZ8MTXP02HBKRA.4.6.A06.1.454.CMB.2.raw
  modified_base (243)..(243): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcgggggcccccggcaggagggtcatcctctcttgttcgtggaggcagctaccaacngtcggaggacatcctgtgagctacggtaccaacaccctcccgaaggaacccgacccccaaactccctacactctaactaacagtactttacgaaacggacggccccgacgtaacgggggtccccaagtactcccggtacttccgtcgtcggctccgaggtcctcggcctacctcaccgtccctccctacgtccactccgagtcggaccttccggtactggacggagtggacgtctagtacttattatttggttacgagggtactgggtaacttacgagtacccttaacgagttcgccgttacggtcgttgggttaccggacggggttaaaccgggaacctaaacggtcggtaacccgttcgtaacggtaccgacggtaccccgtaaggtcccttacccggtcccccg

SEQ ID NO: 364209 - DNA, 573 bp, Homo sapiens
  misc_feature: GZ8MTXP02HL9TV.4.6.A06.1.454.CMB.2.raw
  modified_base (197)..(197): a, c, t, g, unknown or other
  modified_base (473)..(473): a, c, t, g, unknown or other
tcagagcactgtagcacgaccggtgctcgatttagatctactgacaggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggnagagggtcatcctctcttgttctggagcagctccaacatcggaggacatcctgtgagctggtaccaacacctcccaggaaccgcccccaaactcctcactctatacagattctaagacggcccgcgacggggtcccaggatcccgattcctctggctccaggtcctggcacctcacgccctccctgtccatccagtcggactcccggtctggaggtatggaggtctaggtacttactagtttcgttacgagggtatggggaatttacgagtcctanacgtgccgtcggcttggttccgggcgggacggaacccgaaaacgttcggaacccgttcgttaacggtcgacggtaccccaagggtccctccggtcccccg

SEQ ID NO: 364210 - DNA, 665 bp, Homo sapiens
  misc_feature: GZ8MTXP02JCC87.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagagggtcatcctctcttgttctggagcagctcaacagtcggagacatcctgtgacgctacggtaaccaacaccctcccgaacggaacccgaccccccaaactccctacactcctaataacagtattacgtaaagacggcccgacggacggggtccccaagtactcccgtattctcgtcggcctccgaggtcctcggcctacccgtcacgtccctcctcgtcctactcgtagtcggaccgttccgggtactggaaggtacgtggacggtctagaaccttacgttagttcgtacgtaggtagttagggtaacttacgacgtacctaagacgtcgacgttcgggtcgtttcggggttacccgggacgggaaaccgggtaaccctaaaaccggtcggttaaacccggttcgttaaacggggtcctaaaccggacccgtaaacggtcccgtaccccggttccccccgg

SEQ ID NO: 364211 - DNA, 613 bp, Homo sapiens
  misc_feature: GZ8MTXP02HL61Z.4.6.A06.1.454.CMB.2.raw
  modified_base (200)..(200): a, c, t, g, unknown or other
  modified_base (531)..(531): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctaggcccagtctgtcctgactcaggcaccctcagcgtcgtcggggcccccggnaggagggtcatcctctcttgttctggaggcagctccaacagtcggaggacatcccgtgtgagctcggtaacccaaaccaccctccccgaacgggaacccgacccccccaaaactccctacaactacctaataaccagtaacttacctaaaaggcggccccgacgacggggtccccaaggtactcccgtatttcctcgtcggctccgagggttcctgggccacctcacgtccctccctgtcccagtccgagtcgaccgtccggttcgtagaggatggacggtctagacttacttagtttgtacgagggtatgggtattacgacgtcctaacngtcgcgtcggtcgttggtcggacggaacgtacctaacgtcggtaccgtcgtacgaccacgaccgtacggccgtaccgccccg

SEQ ID NO: 364212 - DNA, 693 bp, Homo sapiens
  misc_feature: GZ8MTXP02GRODX.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggcccccgggnaggagggtcatcctctcttgttctggaggcagctccaacatcggaggacatcctgtgagctggtaccaacaccctcccgaggaaccgccccccaaactcctcactctaataccagtattactaaagacggccccgcgaacgggggtccccaggtactcccggaacttcctcgttcgggacctcccgaagggttccgtcgggcctacccgtcacggtccccttaccccgtgtacccatccgtaggtacggaccttcccgggtctcggaggtagttcggacggtccgttaggaccttaaccgttagtttacgttcgaaggggtacgtaggggtacttaccgacgtcccttaacgagttcgccgttcgggctttcggggtttccgggacggggtaacgggtaacccgtaaaaccgttcgggaacccgtttaaccggtttaacgggtaccgaccggtacccccggaaacggtccccgtacccggttccccccccggg

SEQ ID NO: 364213 - DNA, 540 bp, Homo sapiens
  misc_feature: GZ8MTXP02IPGSB.4.6.A06.1.454.CMB.2.raw
  modified_base (236)..(236): a, c, t, g, unknown or other
  modified_base (399)..(399): a, c, t, g, unknown or other
  modified_base (416)..(416): a, c, t, g, unknown or other
  modified_base (450)..(450): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctccaantcggaggacatcctgtgagctggtaccaacaccctccccaggaaccgcccccaaatcctcatctatacagtattctaagacggcccgcgacggggtcccagactccgattctctggctccgagtctggccacctcacgcctcctgtccatcagtgactccgtntgagatgagctgacttntagttgtacgaggactgggtattacagaccttanagtgaccgttcggcttggttaccgggcggaacgggtaccaaaacgtcggaccgttcgtacggtcgacgcccgaacggtcctcgtcccccg

SEQ ID NO: 364214 - DNA, 558 bp, Homo sapiens
  misc_feature: GZ8MTXP02HXHUO.4.6.A06.1.454.CMB.2.raw
  modified_base (237)..(237): a, c, t, g, unknown or other
  modified_base (426)..(426): a, c, t, g, unknown or other
  modified_base (470)..(470): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctccaacntcggagacatcctgtgagctggtaccaacacctcccgaggaaccgccccaaactcctacatcctatacagtattactaagacggccccgcgacggggtccccaggtactccgattcctctggcctcccgaggttcctggaccacctcgacgcccctcctcgtccatcagtcgactcccggtctggaggntggacgtctgactacttattgtcagggatgggattacagcctanatgctcggtcgttggttcgggacggaacggacctaaacgtcgaccggttcgttaacggtcacgacccgaacggtccgttccgcccccg

SEQ ID NO: 364215 - DNA, 572 bp, Homo sapiens
  misc_feature: GZ8MTXP02JIFEE.4.6.A06.1.454.CMB.2.raw
  modified_base (199)..(199): a, c, t, g, unknown or other
  modified_base (234)..(234): a, c, t, g, unknown or other
  modified_base (318)..(318): a, c, t, g, unknown or other
  modified_base (343)..(343): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtctggggccccccggnaggaggtcatcctctcttgtctggagcagctcaanatcggagacatctgtgagctggtaccacacctacccaggaaccgccccaaactcctcatctatacagattcgtaagacggcccncgacgggtcccagatcgacttctcngctcaggtctggcactcacgtcctccctgccatcagtcgactccggtctggacgtagtcggaggtcctagtaaccgttattagttacgttacgagggttagtagggtaacttacgacgtcctacagttgccgtcggtccgttgggttccgggacgggacggaaccgtaacgtcggaccgttcgtaacggtacacggtacccgaaggtcccgtccgacccccgtttccgg

SEQ ID NO: 364216 - DNA, 779 bp, Homo sapiens
  misc_feature: GZ8MTXP02IPL05.4.6.A06.1.454.CMB.2.raw
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtctcggggcccccggcagagggtcatcctctcttgttctggaggcagcctccaacagtcggagacatcctgtgagctcggaccaacacccgtaccgacggaaccggaccccccaaactccctacaactcctaactaaccgagtaactttacgtaaacggcggaccccgcgaacggggtaccccaaggacttaccccggaatttccgtcgttcggggtccttcccgtaagggttccttcgggaccctaaacccttcgaccgttccccctcccgtttcgacccttaactcccgaacggtttcggtaacccgtttcccgggttccgtacgggaagggtaccgttaagggacggtcgttaacggtaaccctttaacgttaagttttcggtaacgtaagggtaacgttaggggtaaactttaaccgaacggtaccccgttaaatacgtttcgaccggttccggtaacgttccggggtttaccgggtaaccgggggtaaccggggaaaaccctaaaacgttcggtaaacccccggtttaaggtttacgggtaacctaccgggaaccccgtaacgggtcccgttcccccggtaaccccccgg

SEQ ID NO: 364217 - DNA, 629 bp, Homo sapiens
  misc_feature: GZ8MTXP02HK0JI.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctcaacatcggaggacatcctgtgagctggtaccaacacctcccaggaaccgcccccaaactccctcatctatacagtattactaagacggcccgcgacggggtcccagatccgattctctggctccgaggtctggccacctcacgccctccctgtcccatcgagtcggaccttccggtctcgaggatggaggtctaggaccttactagtttgttacgagggtagttagggtaacttacgacgtaccctaagtacgttcgccgttccgggtccgtttggggttcccggggacggggtaaaccggggtaaccccgtaaaaccggttcggaaccccggtttaacgttacgggttaccgaccggacccccgtaaacgggtccccgtttacccggccccccgg

SEQ ID NO: 364218 - DNA, 640 bp, Homo sapiens
  misc_feature: GZ8MTXP02IDGD2.4.6.A06.1.454.CMB.2.raw
  modified_base (201)..(201): a, c, t, g, unknown or other
  modified_base (238)..(238): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtcgtcgggggcccccggnagagggtcatcctctcttgttctggagcagctccaantcggagacatcctgtgagctggaccaacaccctcccaggaaccgacccccaaactccacatctatacagacttacgaagacggccccgagacggggtccccagtactcgatttcctcgtggcctcgaggtctgggccctacctcgacgtcccctcccgtgtcccactcgagtcggacctccggtctggaggagtggaggtcctagtaccttacgttagtttgttacgagggtagtagggtacttaacgacgtcctaacgtagtcgtccgtcgggtcgttcgggtttacccggggacgggaaaccggggtaaaccctaaaaccgtccggtaacccggttacgttaacgggtacccaacggtaccccgaaacggtcccgttacccggtaccccccgtttccggg

SEQ ID NO: 364219 - DNA, 659 bp, Homo sapiens
  misc_feature: GZ8MTXP02GJGDC.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtctcggggccccccggnagagggtcatcctctcttgttcgtggaggcagctccaacagttggagacatcctgtgagctggtaccaacaccctacccgacggaacccgacccccaaactcctctatactatacagtattactaaggacggcccgcgacggggtcccaaggactccgacttctcgtcggctccgtagggtctaggcctacctcacgtccctccctgtcccactccgtagtcggtaccgttcccggtcgtggtaggatcggacggtctaggtaaccgttacttagtttacggttactaggggtacttaggggtactttaacgacggtacccttacgagttcggtccgtcgggtcgttacgggtttccgggggaacgggacggggtaaacccgtaaaacgttccggtaacccggttcgtttaacgggaccgtaccggacccgtaaacgggcccgttcccgtccccccgg

SEQ ID NO: 364220 - DNA, 533 bp, Homo sapiens
  misc_feature: GZ8MTXP02FT5A2.4.6.A06.1.454.CMB.2.raw
  modified_base (198)..(198): a, c, t, g, unknown or other
  modified_base (236)..(236): a, c, t, g, unknown or other
  modified_base (255)..(255): a, c, t, g, unknown or other
  modified_base (267)..(267): a, c, t, g, unknown or other
  modified_base (295)..(295): a, c, t, g, unknown or other
  modified_base (381)..(381): a, c, t, g, unknown or other
  modified_base (411)..(411): a, c, t, g, unknown or other
  modified_base (447)..(447): a, c, t, g, unknown or other
tcagagcactgtagcacgaccggtgctcgatttagatctactgacaggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggccccccggnagagggtcatcctctcttgttctggaggcagctccaanatcggagacatcctgtganctggtaccaacncctacccaggaaccgcccccaaactccncatctatacagtattcaagacggcccgcgacggggtcccagtatccgattctctggctccgagtcctggccacctcacgccctccngtccatcagtcgactccgtctgagatgagntgactatattgtcgaggatgggattacgagtcctanatcgctcggtcgtggttcggacgggtaacggaccctaaacgtcggtaaccgtcgttaacggtcacgaccaacggcctcgtcccccg

SEQ ID NO: 364221 - DNA, 687 bp, Homo sapiens
  misc_feature: GZ8MTXP02HABK1.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggccccggnaggagggtcactcctcttcgttgttcgtggaggcagcctaccaacagtcggagacatcctgtgagtctacggacccaaccaccctacccgaacggaacccgaccccctaaactcctacacttactactaacgagtacttacgtaacggccggtacccgacggacggggtacccagtactccgtacttctcgtcggcctccgaggtccgtcgccacctcgaccgtccctccctcgtaccagtccgtagtcgggtaccgtcccggtacgtacggaggtagtacggtaacgtcgtacgtaacttaacgttcgtttagtacggagggttagtacgggtaacttaccgtggtacctacgtacgtcggtccgttacggtcggtacgggttaccgggacgggtaaccggtaaccgtaaaccggttcggtaaacccggttgttaaccgggtaccgaacccggtacccgtaaccggtcccgtacccggttcccccg

SEQ ID NO: 364222 - DNA, 656 bp, Homo sapiens
  misc_feature: GZ8MTXP02H1R13.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctaccaacatcggagacatcctgtgagctaggtaccaaccacctacccgaacggaacccgcccccaaactcctcactctaatacagtattacaagacggcccgacgacggggtcccagtactccgtatttcctctcggtctccgaggtccgtcggcctacccgtcaccgtcccctccctcgtcccattccgacggttcggtaccttcccgggttactagggaggtagtacgggacggcttacggtaaccttacgtttacgtttggttacgagggtagtacgggtaattacgacgtactaacgtagtcgtccgttcggtcgttacgggttccggggacgggtaaacgggtaaccctaaaacggttcggtaacccgtttaacgtacggtaccaccggaccccgtaacggtcccgtacccggtcccccg

SEQ ID NO: 364223 - DNA, 591 bp, Homo sapiens
  misc_feature: GZ8MTXP02H7YBS.4.6.A06.1.454.CMB.2.raw
  modified_base (371)..(371): a, c, t, g, unknown or other
tcagagcactgtagcacgaccggtgctcgatttagatctactgacaggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggcccccgggcagagggtcatcctctcttgttctggatgcagctccaacatcggagacatcctgtgagctggtacccaacaccctcccaaggaacccggcccccaaactcctacatcctaatacagtactttctaaaggacggccccgcgacggggtcccagactcgattctctggcctccgngggtctggcctacctcacgtccctccctgtccatcagtggacctcggtctggagatgagctgactacttagttgttcgaggtagtgggattacgacgtccttacagtcgtcgtccggtcttcgggtttaccgggacggggacggggaaccctaaacggttccggtaacccgttcgttaacgggttcccgaacggcccccgtaaaggggtccctcccccgg

SEQ ID NO: 364224 - DNA, 816 bp, Homo sapiens
  misc_feature: GZ8MTXP02I8G0E.4.6.A06.1.454.CMB.2.raw
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcaggagggtcatcctctcttgttctggagcagctacaacagtcggaggactatcctagtgagcgtacggtaacccaaccaccctaccccgaacgggaaccccggacccccccaaaacttccccacacttactaactaaccagtactttacgtaaaggccggccccgacggacggggtccccaaggtactcccgtattccgtcgtacgggtccttaccgagggttccgtcgggcctaaccccgtcgtaccggtcccctttccccgttgttaccccatttacccgtaaacgggttcgggtaacccgtttcccggggttcgttacggggaacgggtaacgttcgggaaacggggtccttaacgggaacccttttaagttaacggttttcggttacgtaaggggttaaggttacgggggtaactttaaccggacggtaccctttaaacgacgtttacggaccggtttcccggggtatttaccgggggtttccgggggacggggttaaaccggggaaaccccgttaaaacgttcccgggtaacccggtttaaccggttaacgggtacccgtaaaccggggacccgtaaaccggggtcccgtttacccccgggtcccccccgg

SEQ ID NO: 364225 - DNA, 555 bp, Homo sapiens
  misc_feature: GZ8MTXP02I3YFV.4.6.A06.1.454.CMB.2.raw
  modified_base (199)..(199): a, c, t, g, unknown or other
  modified_base (237)..(237): a, c, t, g, unknown or other
  modified_base (290)..(290): a, c, t, g, unknown or other
  modified_base (316)..(316): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggcccccggnagagggtcatcctctcttgttctggagcagctccaacntcggagacatcctgtgagctggtaccaacacctccaggaaccgccccaatccncatctatacagattctaagcgcccgnaggggtcccaggactccgattctctggctccgaggtctggcactcagccctcctgtccatcagtcggactccgtctgagatgagctagactactagttgttacagggtatcgggattacagacctacagtgccttcgggcttgggttccggacgggtaacgggaccgtaaaacgttcggaacccgttcggtttaaacggtccgaacggtacccgaaacggtccgttaccgtccccccgg

SEQ ID NO: 364226 - DNA, 790 bp, Homo sapiens
  misc_feature: GZ8MTXP02IZZA6.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggagcagctaccaacagtcggagacatccgtgtgagtcgtacggtaacccaaccaccctaccccgaacgggaaaccccggaccccccaaactccctacaacttcctaataaccagtactttaccgaaaggaccggccccgacggaacggggtccccaagtacgttcccgtactttccgtcgtacgggtcccttaccggaagggttccgtcgggaccctacccgttcgaccgtcccccttcccgttacggtacccctagttcccgaacgggttccgggtaacccgtttccccggggttacttaggggaaacgggtagttacgggaacgggtcttaaccgggtaaacctttaaccgtttagttttcggtaccggtaaggggtagttacgggggtaactttaacggacggtaacccttaacgtagtcggtccgttacgggtacgtttcgggggttaccgggaaacgggggttaaccggaaaccgtaaaaccggtccggttaacccgtttaacggttaacggtaccgaaaccggtacccggtaacggtcccgtaccccggttaccccccgg

SEQ ID NO: 364227 - DNA, 571 bp, Homo sapiens
  misc_feature: GZ8MTXP02HS7UZ.4.6.A06.1.454.CMB.2.raw
  modified_base (259)..(259): a, c, t, g, unknown or other
  modified_base (274)..(274): a, c, t, g, unknown or other
  modified_base (277)..(277): a, c, t, g, unknown or other
  modified_base (286)..(286): a, c, t, g, unknown or other
  modified_base (305)..(305): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagccccagggaaggactggaatggattgggaacacctattacagtggagccccagctacaatccctccctcaagagtcgactcaccatctcggctgaccgtccaagaatcagtcnccctgagctgacctntgngaccgccgntgacacggccgtctatacngtggagacagtgcagtggtggtcgtgcccccgagtacgtgggcgcggaagtcgttgtctcgtctccttcccacgcctacccaccgaaccgacccgtacgtccgtcccgtccccgtccgtccgtcccgtccgtccgtccgacgacgaccgaccgtaccgacgacgaccgacgacgccggccgcggcgtcgcgtacgtacgtacgtaccgtacctacctacgtacgtcgtcgtcgtcgcggcggacgtacggacgacggacgacgacg

SEQ ID NO: 364228 - DNA, 657 bp, Homo sapiens
  misc_feature: GZ8MTXP02HRL2N.4.6.A06.1.454.CMB.2.raw
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcagagggtcatcctctcttgtctggagcagctccaacagtcggagacatcctgtgagtctacggtacccaacaccctcccgaacggaacccgacccccaaactcctacatctaatacagtattacgtaaagacggcccgacgacggggtcccagactcccgtattcctctggctcccgtaggtcctcggcacccttcgacgtcccctccctcgtaccctatccgagtcggaccgttcccggtgtacggacggtagtcgggacggtctagtaaccgttactttaagtttcgttacgaagggtagtaggggtactttacgacgtacctaacgtagtcggccgttcggtacgttcgggttaccgggacgggtaacgggtaaaccctaacgttacggtaacccgtttaacgttaacggtaccaccggtaccccgaacggggtcccttacccggtccccccgg

SEQ ID NO: 364229 - DNA, 694 bp, Homo sapiens
  misc_feature: GZ8MTXP02IOAJG.4.6.A06.1.454.CMB.2.raw
  modified_base (201)..(201): a, c, t, g, unknown or other
  modified_base (239)..(239): a, c, t, g, unknown or other
  modified_base (540)..(540): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtcgtcggggccccccggnagagggtcatcctctcttgttctggaggcagctccaanagtcggaggacatcctggtgagctggtaccaacacccgtcccgaaggaaccccggaccccccaaaactccctacaacttcctaataccaagtactttaccgaaaggaccggccccgacgtacggggtccccaggaacttcgactttctcgtggcctccgaggttctcgggacctacctccgaccgtccctacccgtgtcccatccgagtcggaccttccggtctggacgagtcggacgtctacgtaacttaccgttatttacgtttcgaagggtagtagggtaattacgacgtacctaacngttcgtacgtcggtcgttcgggttaccggggacgggtaaaccggggtaaacctaaaccggttcggtaacccccggtttaggtttaaccgggtacccgtaaaccggacccccggtaaacgggtccccttacccgggtcccccccgtttaccgggg

SEQ ID NO: 364230 - DNA, 658 bp, Homo sapiens
  misc_feature: GZ8MTXP02FXPOX.4.6.A06.1.454.CMB.2.raw
  modified_base (198)..(198): a, c, t, g, unknown or other
  modified_base (293)..(293): a, c, t, g, unknown or other
  modified_base (353)..(353): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggnagagggtcatccctctcttgttctggaggcagctccaacatcggagacatcctgtgagctggtaccaacacctccaggaaccgcccccaaatccncatctatacagtattcaaagcggccccgacgacggggtcccaaggactccgtaatttccnctacgggcctcccgaagggttcctggcctaaccctccacgtcccctcccgtgtcccatccagtcgacctccggtctcggaggagtgacggctagtactaacttagtttgttacgaagggtagtaggggtacttaacgacggtaccttaacgacgtcgtaccgtccgggtactttcggggtttaccgggacggggtaaaccggggtaacccgtaaaaaccggttccggtaaacccggttaaccggtttaacggtaccgaaaccgggtacccccgaaaagggtccccgttccggtaaccccccccgg

SEQ ID NO: 364231 - DNA, 559 bp, Homo sapiens
  misc_feature: GZ8MTXP02HLUOV.4.6.A06.1.454.CMB.2.raw
  modified_base (199)..(199): a, c, t, g, unknown or other
  modified_base (236)..(236): a, c, t, g, unknown or other
  modified_base (300)..(300): a, c, t, g, unknown or other
  modified_base (321)..(321): a, c, t, g, unknown or other
  modified_base (382)..(382): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtctcggggcccccggnagagggtcatcctctcttgttctggagcagctccaantcggagacatcctgtgagctggaccaacaccctcccaggaaccgcccccaaactcctcatctanacagatttcaagacggcccgngacggggtccccaggactcgacttctctggcctccgaggtctggccacctcacgccctccngtccatcagtcgactcggtctgaggatgagctgacttactattgttcaggtagtaggacttacagtcctacatcgcgtcggtctcggttcgggacggtaagggaaccctaaaacgttcggaaccgttcgttaacggtaccgacgaccccgaaggcccgttaccggcccccgttccgg

SEQ ID NO: 364232 - DNA, 702 bp, Homo sapiens
  misc_feature: GZ8MTXP02IWNV7.4.6.A06.1.454.CMB.2.raw
  modified_base (238)..(238): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcaggagggtcatcctctcttgttctggagcagctcaacntcggagacatcctgtgagctggtacccaacaccctacccgaaggaaccccgaccccccaaactccctacacttcctaataaccagtaactttaccgtaaacgggaccgggtcccccgacggtaacgggggttacccccaaggaacgtttccccggaacttttcccgtccgttgggcccttacccggagggttcctcgggcctaacccgtcgaccgtcccttacccctggtcccaatcgaacgttcggaccttccgggtctagggagagtggacggtcttaggactttagttagtttgtacagggtattagggacttacgacggtacctacgagttcgaccgttcgggtcgtttcgggttcccggggaacggggtaaacggacccgtaaaacgttccggtaaccgtttaacgttacggtaccgacccggggacccttaacgggccccgttacccggtccccccgg

SEQ ID NO: 364233 - DNA, 615 bp, Homo sapiens
  misc_feature: GZ8MTXP02HO6N4.4.6.A06.1.454.CMB.2.raw
  modified_base (265)..(265): a, c, t, g, unknown or other
  modified_base (316)..(316): a, c, t, g, unknown or other
  modified_base (397)..(397): a, c, t, g, unknown or other
  modified_base (454)..(454): a, c, t, g, unknown or other
  modified_base (470)..(470): a, c, t, g, unknown or other
  modified_base (485)..(485): a, c, t, g, unknown or other
  modified_base (510)..(510): a, c, t, g, unknown or other
  modified_base (564)..(564): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattagggaacacctattacagtgggacgccccagctacaactccctcctcaagagtcgactcaccatctcggctcgacctcaagatctagttccncctgacgctcgacctctgtcgaccgccgctgaccaccggcctctacttcgnggtaggacgacagtgcgtagtgggtggtacgtcgccccccgagtacgtcgggccgtagattcgtcggtccacgttcctccncacgtcctacccgacgtaccggccctacgtccggtcccttccccgtcggccctcccncgccctacgacgaccnccctaccgtccgganaccgccgaaccgcgccggtccccgngggtccgacgtccgtcggaaccgtacggaaccctttccacccgaactcgggtcnccgttacgtacggccggggtcggacccggtacggaccgacggtccgacgag

SEQ ID NO: 364234 - DNA, 558 bp, Homo sapiens
  misc_feature: GZ8MTXP02ITEQM.4.6.A06.1.454.CMB.2.raw
  modified_base (201)..(201): a, c, t, g, unknown or other
  modified_base (383)..(383): a, c, t, g, unknown or other
  modified_base (426)..(426): a, c, t, g, unknown or other
  modified_base (431)..(431): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagagggtcatcctctcttgtctggaggcagctcaacatcggagacatcctgtgagctggtaccaaccacctcccgaggaaccggacccccaaactcctacatctataccagtacttactaaagacggcccgcgacggggtcccaagactccgattctacgtggctccgagtcgtcgcacctnacgtcctcctcgtccatccagtcggacttcccggctggacgtnacggngctagacttacttagtttgtcagggtagtcggtaacttagacgctacatcgcgtcggcgttgtcggacggacgtaccaaacgtcgtaccgtaagttacggacacgaccgtaacgcgtaccgtccccg

SEQ ID NO: 364235 - DNA, 612 bp, Homo sapiens
  misc_feature: GZ8MTXP02G4947.4.6.A06.1.454.CMB.2.raw
  modified_base (235)..(235): a, c, t, g, unknown or other
  modified_base (358)..(358): a, c, t, g, unknown or other
  modified_base (422)..(422): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcagagggtcatcctctcttgtctggaggcagctcanatcggagacatcctgtgagctggtaccaacaccctcccgaggaacccgaccccccaaatcctcactctaataccagtattactaaggacggcccgacgacggggtcccaggtactccgattcncgtcggcctacgaggtcctcgggcaccgtcacgtccctcctgtccatcgagtcggactcccgtntcggagacgtgagtctagtacgtacttattgttacgagggtatgggatttacgacgtacctactagtcgtccgttacggtcgttcgggttaccggacgggggtaacgtaaacccgaaacgtacgtaaccgttaaccgtttaagggtacctacggtaacccgaacggttaccgtccggtttaaccccccgg

SEQ ID NO: 364236 - DNA, 684 bp, Homo sapiens
  misc_feature: GZ8MTXP02HF7VT.4.6.A06.1.454.CMB.2.raw
  modified_base (583)..(583): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccggcagagggtcatcctctcttgttctggaggcagctacaacagtcggagacatcctggtgagtctacggtaacccaaccaccctacccgaaggaaccccgacccccctaaaactccctactactactaactacaagtacttacgtaaacgacggccccgacggacggggtaccccaagtactaccccgtattccgtcgtcggccttacccgagggttcctcgggaccctaacccttcgaaccgtccccctccccgtttcgaccctaagtcccgtagtaccgggtaccgttccccgggttagtacggaggtaacgtggacgggtctacggtaacttaacgttagtttcgtacgaagggtacgtgggtaacttaacgacgtaccctaancgtgccgtccggtgttcgtcggggacgggaaccggaaccgtaaaaccgtcggtaccgtaacgttacgaccgaccgaccgtacggccgttccgtccccccgg

SEQ ID NO: 364237 - DNA, 601 bp, Homo sapiens
  misc_feature: GZ8MTXP02IPUSL.4.6.A06.1.454.CMB.2.raw
  modified_base (201)..(201): a, c, t, g, unknown or other
  modified_base (410)..(410): a, c, t, g, unknown or other
  modified_base (445)..(445): a, c, t, g, unknown or other
  modified_base (508)..(508): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagagggtcatcctctcttgttctggaggcagctccaacagtcggagacatcctgtgagctacggtaccaacaccctaccccgaaggaacccgaccccccaaactccctcaactctaataccagtacttaccgtaaagacggccccgacgacggggtccccaaggtactcccgtattcctcgtcggcttccgaggtccgtgcctacctcncgtcctcctgccatcacgtgacctcggtctggagngtgacggtctagtaacttacttagtttgttacgaggtagtacgggtattacgagtaccctaancgtcgtcgtcggtcttggttcgggaccggacggaccgtaaaacgtcgtaaccgttaacgttacggtcacgacccgacgtccgtaccgtccccg

SEQ ID NO: 364238 - DNA, 648 bp, Homo sapiens
  misc_feature: GZ8MTXP02HAIZG.4.6.A06.1.454.CMB.2.raw
  modified_base (199)..(199): a, c, t, g, unknown or other
  modified_base (238)..(238): a, c, t, g, unknown or other
  modified_base (309)..(309): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccggnagagggtcatcctctcttgttctgggagcagctaccaanagtcggagacatcctgtgagctggtaccaacaccctcccgaggaaccgaccccccaaatcctcactctaanacagtacttcgaaacgacgggccccgagacgggggttaccccaaggtacttccccggatttcctaccgtggggcccttcccgaaggttccgtcgggcctaacccttcgacgtccccctacccgtcgtccctatccgtaggtcggaccttcccggtctaggacggtagtcgagggctacggtacttacgttaagtttggtacgagggattagggtaacttacgagtcctacagttcgccgttcggcgtttcgggtacggacgggtaaccggggaacctaaaaccgtcggtaccgttaacgtacggtaccacgacccgaacggtcccgtaccggtcccccg

SEQ ID NO: 364239 - DNA, 711 bp, Homo sapiens
  misc_feature: GZ8MTXP02I30RO.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnaggagggtcatcctctcttgttctggagcagcctccaacagtcggagacatcctgtgagctacggtaccaacaccctaccgaacggaacccgacccccaactcctactactctaatacagtacttacgaacggcggcccgtacggaacggggtccaagtactccgtacttctcgtcgcctcgagtcgtcgctacctcacgtccctcctcgtccatcgtaacggtcggtaccgttcccgtacgtaggacgggtacgttacgggacggtccgttacgtaaccgtttaacgtttaacggtttcggtttacgggaagggttacggttaacggggttaaactttaaccgggaaccttacccgttaaagtacgttccggtaccggtttccgggtacgggtttccggggttaccggggaaccgggggtaaaccggtaaccccgtaaacgttccggtaaccggtttaaccgtacggtaccgaccgaacccggtaccggtcccgtccccgttacccccgg

SEQ ID NO: 364240 - DNA, 615 bp, Homo sapiens
  misc_feature: GZ8MTXP02GP2DD.4.6.A06.1.454.CMB.2.raw
  modified_base (308)..(308): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccggcagacgggtcatcctctcttgttctggagcagctccaacagtcggagacatcctgtgagctggtaaccaaccaccctacccgaacggaacccgacccccaaactccctanactctactacagtacttacaaaggcggcccgcgacggggtcccaagctccgtattctcgtcggtcctccgacgggtctcggacctacctcacgtccctcccgtgtccatcgacgtcgtaccctcggtctaggaggtatcggaggcttacgtaacttaacgttagtttgtacgtagggtagttacgggtaacttacgacgtacctaagtcgtcgtcgtcggtctttcgggtcggacggaacggtaacctaaacgtcggtaccgtaacgttacgaccgtacgaacccgtacggtcctacccgtccccgg

SEQ ID NO: 364241 - DNA, 603 bp, Homo sapiens
  misc_feature: GZ8MTXP02JRAW6.4.6.A06.1.454.CMB.2.raw
  modified_base (328)..(328): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcagagggtcatcctctcttgttctggagcagctcaacatcggagacatcctgtgagctggtaaccaacacctcccaaggaaccggaccccccaaactcctcactctatacagattacaaggacgcccgngacggggtcccagatccgattcctcgtcggctccgaggtcctcggctaccctcacgtccctccctcgtaccatcagtcggaccttcccggtctcggaggtagtggacgtccgtagtaaccttacttagtttcgtttacgagggtaagttaggggtaactttacggacgtcctaacgtactgtccgtacggtcgttcggttcgggacggtacggaaccgtaaacgttcggaccgttcgttacggacgtacgacccgtaacgtcgtacccgtccccg

SEQ ID NO: 364242 - DNA, 689 bp, Homo sapiens
  misc_feature: GZ8MTXP02I3L18.4.6.A06.1.454.CMB.2.raw
  modified_base (201)..(201): a, c, t, g, unknown or other
  modified_base (238)..(238): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcgggggcccccggnaggagggtcatcctctcttgttctggagcagctcaantcggagacatcctgtgagctggtacccaacaccctcccgaggaaccgcccccaaactccctcatctaatacagtacttacaaggacggcccgacgacggggtccccaaggtactccgtacttccgtcgtcgggccttacccgagggttccgttcgggaccctacccgttccgaaccggtcccccttcccgttcgtacccattccgtaggtcggtacccttcccgggtccgttggaaagggtcgttagggacggcgttaacggtaaccttacgttaacgttttcggttacgaggggttaacgttacggggtaactttaacgacggtaccttacgtaacgtcgtacgtccgggtcgttcgggttccggggacgggtaacgggtaaccctaaaacggtccggtaaccgttcgttaacggtacgaccgacccgaacggtcctcccggtacccccg

SEQ ID NO: 364243 - DNA, 591 bp, Homo sapiens
  misc_feature: GZ8MTXP02IFT7D.4.6.A06.1.454.CMB.2.raw
  modified_base (195)..(195): a, c, t, g, unknown or other
  modified_base (367)..(367): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaagggactggaatggattgggaacacctattacagtggancccagctacaatccctcctcaagagtcgactcaccatctcggctcgacccgtcaagaatcagttctccctgaggctgacctctgtcgaccgccgctcgaccgacggccgttctattacgtggtgggagacagtgcgtagtggtggttcgcgccccccgagtacgtgggccgngatcttggcctacgtcctcctcgacgcctacccaccgaacgggccctacgtccggttccctcccccgtggcccgcctcgccgtaccgagacgccgacccgtccgagaccgccgacgacgccggcccgtgggcctcggccgtcggaccgtaacggtaccgttaccttcccgtacgtacggtcgtccgtcgtacgcggccggcgtacggcgaacggcgacgtaacg

SEQ ID NO: 364244 - DNA, 635 bp, Homo sapiens
  misc_feature: GZ8MTXP02IMNU8.4.6.A06.1.454.CMB.2.raw
  modified_base (304)..(304): a, c, t, g, unknown or other
tcagagcactgtagcacgaccggtgctcgatttagatctactgacagggtctcccaggccttgtgaagacctcggagaccctgtccctcacttgcactgtaactctggtggctccatcagcagtttctatggggcttggatccggcagcccccagggaagggactggaatggattgggaacacctattacagtgggacgccccagctacaactccctccctcaagagtcgactcaccatctcggctcgacccgtcaagatcagttctccctgaggctgacctctgtcgacccgccgctcgaccncggccgtctattacgtgtggagacgagtgcagtggtggtcgtcgcccccgtagtacgtcggggccgacggtacttcgttgggtccaccggttctcccgtcgacggtcctacccgaccgaacggcccctacgtccggtcccttcccccgtcgggcccgtcccgtcgcctaccgacggacgtcccaccgtccgaggaccgaccgaccgacggcccggcccgtcggggccgtcggaccgtcggtaccgtaacgggtaccttaccgttacccgtaacgacgtcgtccttcgtcggaacggcggggtcgtcgggaccgacgggaccgacgtaacgg

SEQ ID NO: 364245 - DNA, 682 bp, Homo sapiens
  misc_feature: GZ8MTXP02GWGD3.4.6.A06.1.454.CMB.2.raw
  modified_base (204)..(204): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtccgtcgggggccccccgggnaggagggtcattcctcttcttgttctggaggcagcctccaacagtcggagacatcctgtgagctcggtaacccaacaccctccccgaacggaacccggaccccccaaaactcccctacactcctaataaccagtacttacgtaaaggcggccccgcgaacggggtccccagactccgtattctcgtcggctccgagtcctcggcctacctcacgtccctccctgtccatcagtcggacctccggtctaggagagtggacgcttacgacttactagtttgttacgagggtagtaggggtactttaacgacggtacccttaacgtagttcggtcccgttcgggtccgttggggtttacccggggaaccggggaaccggggtaaaccccgtaaaacggttccggtaaacccggttaaccgtttaaccggggtaccaacccgggaccccgtaaacgggtccccgttacccggtcccccccgg

SEQ ID NO: 364246 - DNA, 704 bp, Homo sapiens
  misc_feature: GZ8MTXP02JQ3NW.4.6.A06.1.454.CMB.2.raw
  modified_base (199)..(199): a, c, t, g, unknown or other
  modified_base (237)..(237): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggcccccggnagagggtcatcctctcttgttcgtggagcagctccaantcgggagacatccgtgtgagtcgtacggtaaccaacctaccctaccccgaaacgggaaccccgaccccccctaaaactccctacactctaactacagtacttacgaagacggcccgacgacggggtcccagtactccgtattcgtcgtacgctaccgaggttcgtcggctaaccctcgacgtccccttccctagtcccaatcgacgttcggtaccctccgggttctacggagggacgtaggacggtcgtacggtaccttaaccgtttagtttcggttacgaacggggtagttaccggggtaatttaccgaaccggttacccttaaccgtagtcgtacccgttcgggtacccgttggggttacccgggggtaccggaaacggggaaaccctaaaccgggttccgtaaccggtttaacgtaccggtacgaaccggacccgtaacggtcccgttacccggtaccccccgg

SEQ ID NO: 364247 - DNA, 513 bp, Homo sapiens
  misc_feature: GZ8MTXP02G8HMC.4.6.A06.1.454.CMB.2.raw
  modified_base (236)..(236): a, c, t, g, unknown or other
  modified_base (266)..(266): a, c, t, g, unknown or other
  modified_base (320)..(320): a, c, t, g, unknown or other
  modified_base (398)..(398): a, c, t, g, unknown or other
  modified_base (404)..(404): a, c, t, g, unknown or other
  modified_base (447)..(447): a, c, t, g, unknown or other
  modified_base (475)..(475): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctcaacntcggagacatcctgtgagctggtaccaacncctcccaggaaccgcccccaaactcctcatctatacagattcaaagcggcccgnaggggtccccagactcccgattctctggcttccgaggtctgcacctcacgccctcctgtcccatcagtcgactccgtntgacgntgaggctagacgtactagttgttcaggatggattacagcctantgctcggctgtcggcggacggacaaacngaccgtgttacggctacggcccaaggtcacgtcccccg

SEQ ID NO: 364248 - DNA, 788 bp, Homo sapiens
  misc_feature: GZ8MTXP02G8EXR.4.6.A06.1.454.CMB.2.raw
  modified_base (179)..(179): a, c, t, g, unknown or other
  modified_base (200)..(200): a, c, t, g, unknown or other
  modified_base (213)..(213): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctnagcgtcgtcggggcccccggnagaggtcatcctntcttgtctggagcagctacaacatcggagacatccgtgtgacgctacggtaccaaacaccctcccgaaggaacccgacccccaaaatccctacaactactaactaaccgagtaacttacgtaaaaggaccgggtccccgacgtaaaccgggggtcccccaaaggtacgttaccccggtaactttcccgttaccgtacggggtaccctttcccggaaacggggtttcccgacggggtcccctaaaccccgttccgaaccggtccccctttacccccgttggttaccccaacgttcccgtaaaggtttcccggggaaacccgtttccccggggttcgttaccgggaacgggtaacgtttagggaacgggtcttacggtaacctttaaccgttagttttcgtacgtaagggtaagtacgggtaacttaaccgacggtacctttacgaagttcgaaccgttcggcgtttacgggtaccggacgggtaaacggaacccgtaaaacgtccggtaaaacccggttgtttaaaccggccgtaaccggtacccgaaacgggtccctttacccggtcccccccgg

SEQ ID NO: 364249 - DNA, 694 bp, Homo sapiens
  misc_feature: GZ8MTXP02IASCL.4.6.A06.1.454.CMB.2.raw
  modified_base (199)..(199): a, c, t, g, unknown or other
  modified_base (443)..(443): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcgggcccccggnagagggtcactcctctcttgttcgtggaggcagctaccaacagtcgggaggacatccgtggtgagtctacggtacccaacacccctacccgaacggaacccgacccccctaaatccctacacttactaatacagtacttacgtaaaggacggcccgacgacggggtcccaagtactcccgtacttcctcgtggcctccgaggttctcggcctaccttcgaccgtccctcccgtacgtccctacnccgtaggtccggtacccgtcccgggttcgtagggacggtacgtagggtacggtaccgtacggtaacctttacgttagttttggttacgagggtagttagggaactttacgacgttacctaactacgtcgccggttccggtcgttcggggttaccggaccggggtaacggtaacccgtaaaccggtccggaccgttaaccggttacggacccgtaccggaacccgtacggtcccgttacccggtccccccgg

SEQ ID NO: 364250 - DNA, 716 bp, Homo sapiens
  misc_feature: GZ8MTXP02HI2HQ.4.6.A06.1.454.CMB.2.raw
  modified_base (200)..(200): a, c, t, g, unknown or other
  modified_base (238)..(238): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnaggaggtcatcctctcttgtctggaggcagcctccaanatcggagacatcctgtgagctggtaaccaacgaccctcccaacgggaaccgaccccccaaactcccgtacattactatacagtacttcaaggtacggccccgacgacggggtcccaggtactcccgtatcgtctggctaccgaggtcacggcacctcgacgtccctcctcgtacctatcccgagtcggacctccggtctcggaggtaactcgggacggtctagggaaccctttaacgttacggtttttacggtacgaaggggttaacggttaacgggggtacttttaaaccggacgttacccttacggtaacgttgtaccccgtttcggggtacctttcggggtttacccggggacgggggtaaaacccgggtaacccgaaaaccggtttcgggtaacccccggtttaaggtttaccgggtaaccacccggggtaacccgtaaaccgggtccgtttacccccgggtttaaccccccgg

SEQ ID NO: 364251 - DNA, 706 bp, Homo sapiens
  misc_feature: GZ8MTXP02GT043.4.6.A06.1.454.CMB.2.raw
  modified_base (201)..(201): a, c, t, g, unknown or other
  modified_base (240)..(240): a, c, t, g, unknown or other
  modified_base (259)..(259): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnaggaggtcatcctctcttgttcgtggagcagctaccaanagtcggagactatccgtgngacgctacggtaacccaaccacccgtaccccgaacgggaaacccccgacccccctaaaactcccctactaactacttaactaaccgaagtaacgttaccgtaaacgggaccggccccggacggtaaccgggggtccccaaggtaactccccgtatttccctgtcggcctaccggagggttcctcgggaccctaaccctcgacccgtcccctcccttcggtaccctacgtccgaaggtccgggtacccgttcccggtagtcgggaacggtacgtgggacggttcctacggttaacctttaacgtttagtttcggtaacgtaagggtagttacgggttaattaccgacgtacctacgtatcgtccggtcggtacgttggtaccgggaccggaacggtaccaaacgtcggtacgtcgttacgcgacctacgaccggtccgtccgtccccg

SEQ ID NO: 364252 - DNA, 663 bp, Homo sapiens
  misc_feature: GZ8MTXP02J0023.4.6.A06.1.454.CMB.2.raw
  modified_base (318)..(318): a, c, t, g, unknown or other
  modified_base (625)..(625): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcagcccccagggaaggactggaatggattgggaacacctattacagtgggagcccagctacaactccctccctcaagagtcgactcaccatctcgctcgacccgtcaagaatcacgttctccctgacggctgacctctgtcgaccgccgctcgaccacggccgttctacgttacnggtggagacagtgcgtaggtggtggtcgtcgccccccgtagtacgtcggggccgaggaacttcgttcgggtacctacccgggttcctcccgttaccgaccggtccccttacccgaacccgaaaccggggtccccctacgttccccggttcccgttccccccgttcgggccccgcccccgttacgcccttcccgacggaccgacccgacccgtaccggacgacgacccgacgaccggccgggtcccgtcggggcctcggccgtacgggtaccaaacgggtaccctaccgttacccgtacgtacggtcnccgtcgtacgcggccggtcgcggacgaccggcgacgag

SEQ ID NO: 364253 - DNA, 788 bp, Homo sapiens
  misc_feature: GZ8MTXP02HDXID.4.6.A06.1.454.CMB.2.raw
  modified_base (199)..(199): a, c, t, g, unknown or other
  modified_base (236)..(236): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcacctcagcgtcgtcggggcccccggnagagggtcatcctctcttgttctggagcagctccaantcggagacatcctgtgagctcggtaccaacaccctaccccgaacgggaacccgaccccccaaactccctacactactaactaacgagtaacttacgtaaacggccgggaccccgacgaacggggttccccaaggtctaccccggtattcctcgtcggtcctccgaacgggtcgttacgggccctaacccgttccaaccggtcccccgttccccttacggttaccctacgttacccgtaaggtccggggtaacccgttcccgggtcgttacggaacgggtagttacgggaacggtcgttacggtaaccttaaccgtttagtttacggttacggtaagggttaaggttacggggtaactttaaccgacggttacccccttaaacgtagttcggtacccggtttcgggtacccgggtttcggggtttacccgggggacgggggaaacccgggttaaacccggtaaaaccgttccgggtaaccggtttaaccggttaaccggttacccggtaaacccgcccggtaaacgggtccccgtacccggttacccccccgg

SEQ ID NO: 364254 - DNA, 777 bp, Homo sapiens
  misc_feature: GZ8MTXP02GZZ3V.4.6.A06.1.454.CMB.2.raw
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggcaggagggtcatcctcttcttgttcgtggaggcagctaccaacagtcggagacatccgtgtgagcgtacggtaacccaaccacccctacccggaacggaaccccggacccccccaaaactcccctactaacttacctaactaaccgaagtaactttacgtaaaacgggaccggcccccggacgaaccgggggttccccaaggtactacccgtactttcctccgtacggcctaccgaggtccgtcggcctacccgtcgaccgtccccttccctcgtaccacgttccgtaaggttccgggtacccttcccggggttatacgggaacggggtaacttcgggaaacggggtccttagggtaacccctttaaggttacgttttacggttaaccggtaagggggtagttaacggggtaactttaaccggacggttaccttaaaccgacgttcgtaacccggttcgggtaccgtttggggttacccggggaacggggaaaccggtacccgtaaaacgtccgggtaaccgttaacggttacgtaccggaccgacccgtaacggtccccgttcccggtacccccgg

SEQ ID NO: 364255 - DNA, 629 bp, Homo sapiens
  misc_feature: GZ8MTXP02I1OZR.4.6.A06.1.454.CMB.2.raw
  modified_base (202)..(202): a, c, t, g, unknown or other
  modified_base (317)..(317): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcgggggccccccggnagagggtcatcctctcttgttctggagcagctaccaacatcggagacatcctagtgagtctacggtaccaacaccctacccgaggaacccgaccccccaaatccctatactctanacagtattcaaagcggcccacgacggggtccccaggtactccgtacttctcgtacggtcctccgaggtcctcgggccctaccgtccaccgcctcccgtgaccctatacgagtcggaccgttccggtctacggaagtgtaggacggtctaggtacctttaaagttgttgttacagggttacgtagggtaccttacgacgtacccttagtagtcgtccgtcggtcgttaacgggtccgggacggaacggtacctaaacggtcggtaccgttaacgtacggtaccacggacccgtacggtcctacccgtcccccg

SEQ ID NO: 364256 - DNA, 650 bp, Homo sapiens
  misc_feature: GZ8MTXP02F78Z8.4.6.A06.1.454.CMB.2.raw
  modified_base (198)..(198): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctcagcgtcgtcgggccccggnagaggtcatcctctcttgttctggagcagctaccaacatcggagacatcctgtgagtctacggtaaccaaccaccctacccgaacggaacccggacccccaaaactcctacatcctaatacaagtattcgtaaaagaccgggccccgacgtaacggggtccccaagtactcggaacttcctcgtacgccttccgaggttctcggcctaacctcgaccgtccctcctcgtccagtctacgtacggaccttccggtacgtacggaggtaagtggacggtacgttacgtacttaaccgtttagttgtttacgaagggtagtagggtaactacgagtacccgtatacgtcgtacgtcggtcgttcgggttacgggaccggggaacggtaaaccctacggtaccgtacgtaccgtttaacggacgaccgaccgaacgtccgcccgtaccccgtccgg

SEQ ID NO: 364257 - DNA, 814 bp, Homo sapiens
  misc_feature: GZ8MTXP02FVACB.4.6.A06.1.454.CMB.2.raw
  modified_base (200)..(200): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgttctggaggcagcctccaacagtcggagacatcctgtgagcgtcggtaccaaccaccctccccgaacggaacccgaccccccaaactccctacactctatacagtacttacgaaaggcggccccgacgacggggtccccaaggtactcccggtactttccgtacgttcgggtccctacccgtaaggggttccgtacggggaccctaacccgttccgaaccggttcccccctttcccccgttacggttacccctacgttacccgtaacgggttaccgggtaacccggtttcccggggttacgtacggggtaaggggtaacgttcgggtaacgggtccgttaacgggttaaacctttaaccgtttaaggttttacggtttaccggtaaaggggttaaggttacgggggttaaactttaaccggtaacggttaccccgttaagtaacggttcggtccggttaccgggttacgtttcgggggtttaccggggaaccggggtaaacggggtaaaccccgtaaaaccggtcggtaacccggttaacggtttaacggtaccgaaccggtacccgtaaacgggtcccgtacccggtcccccgg

SEQ ID NO: 364258 - DNA, 601 bp, Homo sapiens
  misc_feature: GZ8MTXP02HO5BM.4.6.A06.1.454.CMB.2.raw
  modified_base (200)..(200): a, c, t, g, unknown or other
  modified_base (236)..(236): a, c, t, g, unknown or other
  modified_base (373)..(373): a, c, t, g, unknown or other
  modified_base (387)..(387): a, c, t, g, unknown or other
  modified_base (428)..(428): a, c, t, g, unknown or other
  modified_base (509)..(509): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnagagggtcatcctctcttgtctggagcagctcaacntcggagacatcctgtgagctcggtacccaacaccctcccgaaggaactccggacccccaaactcctcatcctatacagtacttcgtaaacgacggcccgcgacggggtcccagacctcgatttctcgtggccttcgnggtctggccacctncgccctccctgtcccatcgagtcggacctcgtctagacggntgacgcgtgacttactttagttgttacgagggagttacggggtatttacgacggtaccctagtagtccggtcgtccgggtnttcgggttcgggacgggaccggtaaccgtaaaacgtcggtaaacccgtttcgtaacgggttaccacggtacccgtaacgggtcctcccccgg

SEQ ID NO: 364259 - DNA, 730 bp, Homo sapiens
  misc_feature: GZ8MTXP02HL8QF.4.6.A06.1.454.CMB.2.raw
  modified_base (179)..(179): a, c, t, g, unknown or other
  modified_base (200)..(200): a, c, t, g, unknown or other
  modified_base (273)..(273): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctnagcgtcgtcggggcccccggnaggagggtcatcctctcttgttctggagcagcctacaacagtcggaggacatcctgtgagctaggtaccaacnccctacccgaggaaccgacccccaaactcctcatctatacagattctaagcggccgacgtaggggtcccagtactccgtacttccgtcgtcggtccttcccgtaagggtcctcgggtacccacccgttaccgaccgtcccccttcccccgttcgtaccctacgttccgtaacgggttccgggtaccgttcccgggtcttaggacgggtacgttgggacgtacgtacggtaacccttaacgtttaacgtttcgggtttacgaagggtaacggtttacggggtaactttaaccggacggtaacccttacgtaacgttcggtacccggttccgggtcgttacgggggtttccgggaacgggggaaaccgggtaacccgtaaaaccggttccggaacccgggtttccgttaacggttacccgaacggtaccccgaacggtccctacccggtttccccccgg

SEQ ID NO: 364260 - DNA, 688 bp, Homo sapiens
  misc_feature: GZ8MTXP02IE9YW.4.6.A06.1.454.CMB.2.raw
  modified_base (202)..(202): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtccgtcggggcccccgggnaggagggtcatcctctcttgttcgtggaggcagctaccaacagtcgggagacatcctgtgagctacggtaacccaaaccaccctacccgaacgggaaccgaccccccaaactccctacactactaatacagtattacgtaagacggcccgtacgaccggggtcccagtactccgtacttctcgtggcctcccgagggttcctcgggacctaccccttcgacccgtccccctcccgttaccgtcccaactccgaaggtccggacccgtttcccggtagttacgggaggtacgcgggtacggtcttaacggtaccttacgttagttttacggtacgaagggtagttcggggtaactttacgacgtacctactagtcgtccgtcggtcgtttcgggtacgggaccgggaacggtaaccctaacggttccgacggttaacgtttaccgggacgtaccgtacccggtacggtacccgtaccggtccccccg

SEQ ID NO: 364261 - DNA, 721 bp, Homo sapiens
  misc_feature: GZ8MTXP02FQ9T6.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnaggaggtcatccttctcttgttcgtggagcagcctaccaacagtcggagactactcctgtgacgtcgtacggtaaccaaccacccgtacccgaacggaaaccccgacccccctaaatcccactactacctaataccaagtacttacgtaaaacgggccggaccccggacgtaccgggggtaccaaggtacttccccggtactttccgtacgtcgggtcctacccggtaggttcgccggtccaacctcgaccgtccctttccgcgtacctataccgtaggttccggtacccgttccgggttacgacgggtaaggtacgttcggaacggttcgttaaccggtaaaccgttattacggttagttaccgaaggggttactaacgggtactttaaccgacgttaacctgtacgtccgtcgttaccggtggtttacgggtaccgggaacgggtaaaccggtaaccgtaaacgtcggtaaaccgtgttacggaaccgacgtaccgacgtccccgtacggttaccccg

SEQ ID NO: 364262 - DNA, 851 bp, Homo sapiens
  misc_feature: GZ8MTXP02GK21Z.4.6.A06.1.454.CMB.2.raw
  modified_base (201)..(201): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcgggggcccccggnaggagggtcatcctctcttgttctggaggcagctccaacagtcggaggacatcctgtgagctacgggtaaccaaccaccctacccgaacgggaacccggacccccctaaactccctaccaatacctactaacaagtacttaccgtaaacgggaccggcccgacggtacggggtaccccaaggtactaccggtactttcctcggtcggtccctacccgagggttccgttacgggaccacccgttcgtaccggtccccctttccctacggtaccctaacgttccgtaacgggtcggtaacccggttcccgggtttacgtccgggtaaggggaacgttcgggaccgggtacgttaccgggtaaacctttaaccggtttaaagttttcggggtttacctaacgggggttaagttaacgggggttaaacttaacgtaacccgggtacccttaaaccgtaacgttaccggtaccggtttccggggtaccgtttcggggtttacccggggtaccgggggaaaccgggttaaaccccggtaaaacggttacccggggttaaacccggtttaaccgggtttaaaccggggttaccggtaaccccgggaacccccggtaaaaccgggtcccggttcccccgggtttaaccccccccgggg

SEQ ID NO: 364263 - DNA, 551 bp, Homo sapiens
  misc_feature: GZ8MTXP02J1ZI1.4.6.A06.1.454.CMB.2.raw
  modified_base (179)..(179): a, c, t, g, unknown or other
  modified_base (197)..(197): a, c, t, g, unknown or other
  modified_base (233)..(233): a, c, t, g, unknown or other
  modified_base (424)..(424): a, c, t, g, unknown or other
  modified_base (455)..(455): a, c, t, g, unknown or other
tcagagcactgtagcacgaccggtgctcgatttagatctactgacagggggcttcggctgtgggtagagaagacaggactcaggacaatctccagcatggccagcttccctctcctcctcaccctcctcactcactgtgcagggtcctgggcccagtctgtcctgactcaggcaccctnagcgtctggggccccggnagagggtcatcctctcttgtctggagcagctcaacntcggagcatcctgtgagctgtaccacacctccaggaaccggccccaaactcctcactctatacagtattactaagacggcccgtacgacggggtcccaaggactcgattctctggctccaggttctggcaccgtcacgccctccgtgccatcagtcggacctcggtctggagatgaaggctagaactactnttacgttcagtagtaggattacgagacctanatcgacgtcgtcgttaggtcgggacggacggaccgtaacgacgtaaccgtcgttaacggccgacggaccccgaggcccttccgggaccccttccgg

SEQ ID NO: 364264 - DNA, 616 bp, Homo sapiens
  misc_feature: GZ8MTXP02G3I0T.4.6.A06.1.454.CMB.2.raw
  modified_base (201)..(201): a, c, t, g, unknown or other
  modified_base (429)..(429): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggccccccgggnagagggtcatcctctcttgttctggaggcagctccaacatcggagacatcctgtgagctggtaccaacacctcccgaaggaaccgacccccaaactcctacactctaatacagtattactaagacggcccgcgaacggggtccccaggtactccgattcctcgtaggcctccgaggtccgtggaccacctcgacgtccctccctgtcccatcgagtcggactccggtntcggagtagtgaggtctagacttactattcgtcagggtagtgggtaattacgacgtctaacgagtcgtccgtcggtccgtggttacgggaccgggtaacggggaacccaaaacggtcgtaacccggtttaacgttacgggtaccgaccggaaccccgaacgggtccccgttaccggtacccccccgg

SEQ ID NO: 364265 - DNA, 515 bp, Homo sapiens
  misc_feature: GZ8MTXP02FI1E9.4.6.A06.1.454.CMB.2.raw
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctgggcccccggcagagggtcatcctctcttgttctggaggcagctccaacatcggaggacatcctgtgagctggtaccaacacctcccaggaacggcccccaaactcctcatctatacagattctaagaggcccgcaggggtcccagatccgattctctggctccaggtctggcacctcagcctccctgtccatcagtggactcccggtctgaggatgaggctgactactattgttcagggatgggattacagcctacatgctcggctgttcggcggagggacccaaaacgtgaccgtcttaggtcacggcccaaaggctcgtccccccg

SEQ ID NO: 364266 - DNA, 592 bp, Homo sapiens
  misc_feature: GZ8MTXP02J0R04.4.6.A06.1.454.CMB.2.raw
  modified_base (332)..(332): a, c, t, g, unknown or other
  modified_base (355)..(355): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggccccccggcaggagggtcatcctctcttgttctggagcagctcaacatcggagacatcctgtgagctggtaaccaacacctaccccgaggaacccgcccccaaactcctacactctatacagtattacgaagcggcccgngacggggtcccagatccgattcnctggctcgaggtcaggccacctcacgtcccttccctgtcccatcgtacgtcggaccgtcccggtgtggaacggtagtggacggtctacggtacttaccgttagttcgttcgaagggtagttagggaactttacgacgtctacagtcggaccgttcggcgttggtccggggacggaacggaacctaacgtcgtaccgttcgtacggtccgacggaccgtacggtcctccggtcccccg

SEQ ID NO: 364267 - DNA, 664 bp, Homo sapiens
  misc_feature: GZ8MTXP02HAF4M.4.6.A06.1.454.CMB.2.raw
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcgggggcccccggcaggagggtcacgtccttcttcttgttctggagcagctccaacagtcggaggacatccgtgtgagctaggtacccaaccgaccctcccgaacggaaccccggacccccaaactccctacactactaactaaccagtaacttacgtaacggacggcccgcgacggggtccccaagactccgtacttctcgtcgtcctacccgaggtcgtcggcctaaccgtccacgtcccctccgtcgtacctactcgtacgtcggaccgtcccggttactacggacggtacgtcggacgggtctaacggtacttaacgttagtttacgttacgaaggggttatacggggtactacgaacggtcctaacgtatcgtcgtcggacttcgggtacgggacggtaacgggaacctaaacgtccggaaccgttcgttaacggaccgaccgtaccgaacggtccgtacccggtcccccg

SEQ ID NO: 364268 - DNA, 781 bp, Homo sapiens
  misc_feature: GZ8MTXP02G2SJ2.4.6.A06.1.454.CMB.2.raw
  modified_base (200)..(200): a, c, t, g, unknown or other
  modified_base (239)..(239): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggnaggaggtcatcctctcttgttctggagcagcctaccaanagtcggagacatccgtgtgagtctacggtaacccaacctacccctaccccgaacgggaaccccgacccccctaaaactcccctactactactaactaaccagtaactttaccgtaaacgggaccgggaccccgtacggaaccggggtaccccaaagtacgtacccggtaactttccgtacgtcgggaccttccgaagggttccgtaccggacctaccccgttccaccggtcccccttccccgttacgtccctacgtccgtaacggtcgggtacccgttcccgggtacgtacgggaaggtacgtacgggtacgggtccgtaacgttaaccgtttaacgttaacgttttcgtacggtaaggggttaacgtacggggttaacttaaccgtacggtaccctttaacgacgttcggtacccgttcgggtaccgtttaccggggttacggggaccggggtaaacggtaaacccgtaaacgttccggtaaccgttaacggttacggttaccgacgtacccggtaacggtcccgtacccggttcccccgg

SEQ ID NO: 364269 - DNA, 662 bp, Homo sapiens
  misc_feature: GZ8MTXP02F4CV8.4.6.A06.1.454.CMB.2.raw
  modified_base (201)..(201): a, c, t, g, unknown or other
  modified_base (312)..(312): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagaggtcatcctctcttgttcgtggagcagctacacagtcggagacatcctgtgagctacggtaccaaccgacccctaccccgaacggaaccccgacccccaaactccctnactctaatacgatacttacgtaagccggacccgacgacgggccagactcgtacttcctcgtcggcctaccgaggttccgtcgaccctccgtaccgaccgtccccttaccgtcgtcccacgttcccgtaggtcggtacccttcccggtacgtaggtaacgtgtagacggtctacgttaactaccgtttgttaggttactagggtacgttacggttacgttaacgcgtaccttaacgcgtacggtccgttcggtcggtttcgggtaccggacggggtaaaccgaaccgtaaaccgttcggtaaccgttcgtaacggtaccaccgacccgtacggtccgtacccggtcccccg

SEQ ID NO: 364270 - DNA, 606 bp, Homo sapiens
  misc_feature: GZ8MTXP02JPDIW.4.6.A06.1.454.CMB.2.raw
  modified_base (438)..(438): a, c, t, g, unknown or other
  modified_base (514)..(514): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcaggacgggtcatcctctcttgttctgggaggcagctaccaacagtcggaggacatcctgtgagctacggtaccaacacctacccgaaggaacccgaccccctaaactcccactacttactaataccagtacttacgtaaacggcggtcccgcgacggggtcccagactccgtattctcgtgctcgagtctcggcacctcgacgcccttccctgtccatcgacgtcggacgttccggtntacggaggtacgtaggacgtctacgacttacttagtttcgtacgaagggtacgtaggtacttacgacgtacctagnttcgcgtcggcgttacggtccgggacggaacggaacctaaacgtcgtaaccgttcgtaacggtccaacgccgaacggtccctcgtacccccg

SEQ ID NO: 364271 - DNA, 632 bp, Homo sapiens
  misc_feature: GZ8MTXP02JV1NL.4.6.A06.1.454.CMB.2.raw
  modified_base (260)..(260): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtcggggcccccggcaggacgggtcatcctctcttgttctggaggcagctaccaacatcggagacatcctgtganctggaccaacacctccgaacggacccgacccccaaactcctacactctaactacaagtattacctaaggacggtcccgacgtacggggtccccagtactcccgtatttccgtcgtcggacctccgaggtcctcggacctaccctcacgtccctcctcgtcctattcgaggtacgaccgttcccggtacgtgaggtactaggacggcttagtacttaactgttgttacagggtacgtaggtacttaacgcgtactacgtagtcgacgttcggtcgttcgggtacgggacggtacgggtaccctaaaacgttcgggaccgttaacgttacggtacccgacggtaccccgaacggtcccgtaccggtccccccgg

SEQ ID NO: 364272 - DNA, 618 bp, Homo sapiens
  misc_feature: GZ8MTXP02FIJZM.4.6.A06.1.454.CMB.2.raw
  modified_base (199)..(199): a, c, t, g, unknown or other
  modified_base (380)..(380): a, c, t, g, unknown or other
  modified_base (540)..(540): a, c, t, g, unknown or other
  modified_base (608)..(608): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctcggggcccccggnagagggtcatcctctcttgttctggaggcagctaccaacagtcggagacatcctgtgagctggtacccaacaccctaccccgaacggaacccggaccccccaaactccctacacttcctaataccagtactttacaaaggacggccccgcgacggggtcccaaggtactcccgtatttccncgtcggcctccgagggttctcgggacctaccctcgaccgtccctccctgtacccatccaggtcggtaccttcccgggtctggaggtagtggacgctagaaccttaagttgtttgtacgagggtagtagggtactacgagtcctaagattcgcgtccggtnttcggtccggacgggtaacgtaaccaaacgtcgtaaccgttcgtaacggtcacggtacccaaggtccncccgtccccg

SEQ ID NO: 364273 - DNA, 639 bp, Homo sapiens
  misc_feature: GZ8MTXP02IFQYS.4.6.A06.1.454.CMB.2.raw
  modified_base (195)..(195): a, c, t, g, unknown or other
  modified_base (263)..(263): a, c, t, g, unknown or other
  modified_base (298)..(298): a, c, t, g, unknown or other
  modified_base (392)..(392): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcacgcccccagggaaggactggaatggattgggaacacctattacagtggancccagctacaactccctcctcaagagtcgactcaccatctcggctcgacccgtcaagaactcagttcnccctgacgctgacctctgtcgaccgccgctcgacncggccgttctattactggtggagacagtgcaggtggtgttcgcgcccccgagtacgcgggccgcgtaacttcgttgggcctaccgtcctcctcncgtccctacccgaccgaacgggccctacgtcccggttcccttcccccgtcgcccgtccctcgccctaccgacgggacgcccgtaccgccggaacgacgccgaaccgaccgggcccggtcccggtcgggtaccgttccggtccgtacgggtaccgaaacggttaccgttaccctttacccgtaaacgtcggtccgtcttccggtacggaacgggtccgggcgtacgggacgtaacgggccgacgtaag

SEQ ID NO: 364274 - DNA, 751 bp, Homo sapiens
  misc_feature: GZ8MTXP02FIBA8.4.6.A06.1.454.CMB.2.raw
  modified_base (198)..(198): a, c, t, g, unknown or other
  modified_base (264)..(264): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgcgggcccccggnagagggtcactcctcttcgttgttcgtggaggcagctaccaactatcgggagacatcctgtgacgngtacggaacccaaacctccctaccccgaacgggtacccccgaccccctaaaactcccctacaacgttacctattaaaccaggttaactttacgaaacggccggaccccggacggttaaccgggggccccaaggtactaccccgtactttcccgcgttacggcccttacccgtagggtccctggggaaacccctaccggttacccgtacccgtcccttcccgtactacccgacgttaccgtaacgggttccggtacccgttccggttcgaacggggtaacggtacgttacgggacggtccgttaacgtaaacctttaacgtttcgtttacgttacgtaacggtaaggtacggtacgtaacgtacgtacctaacgtacgtacgtcgtaccggtcggttcggtacgggtacgggaaccggtaaccgtaaccgtaaccgtaccgttaacgttacggtaccgaccgacccgtacggtaccgtacccgtcccg

SEQ ID NO: 364275 - DNA, 775 bp, Homo sapiens
  misc_feature: GZ8MTXP02G7XDN.4.6.A06.1.454.CMB.2.raw
  modified_base (201)..(201): a, c, t, g, unknown or other
  modified_base (262)..(262): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggccaccctcagcgtcgtcggggcccccggnagaggtcactcctcgttcttgtcgtggagtcagcctaccaacagtcggagacactccgtgngacgtcgtacggtaccaaccgaccctacccgacggaaccccgaccccctaaactccctactacttaccgtaactaacgacgtacttaaccgtaaacggaccgggtacccgacggtaccggggtccaaggtacctccgtactttccgtcgtcggtcctccgaggttccgcgtacctacccgtccaccgtccctccccgttcgtaccctacgtccgtaaggttccggtaacccggttcccgggttacgtaccggggtagggttaaccgtacgggtacgggtcccttaaaggggtaaccccttttaagtttcggttttacggttaaccggtacggggtttaacgttaacggggttaactttaccgggaaacttcccgttaagacgtcgtcccggttcgtcggttaacgggtccggggtaacgggaaaccggtaccgttaaaaccggcgttaaccggttaacgttaccggaaccgttaccgaaccccgggtacgtccccggttacccgtaaccccgg

SEQ ID NO: 364276 - DNA, 747 bp, Homo sapiens
  misc_feature: GZ8MTXP02FKEI4.4.6.A06.1.454.CMB.2.raw
  modified_base (551)..(551): a, c, t, g, unknown or other
  modified_base (587)..(587): a, c, t, g, unknown or other
tcagagcactgtagcacgaccggtgctcgatttagatctactgacagggtctcccaggccttgtgaagacctcggagaccctgtccctcacttgcactgtctctggtggctccatcagcagtttctatggggcttggatccggcacgcccccagggaagggactggaatggattgggaacacctattacagtgggagcccagctacaactccctcctcaagagtccgactcaccatccgtcgctaccgaccctacaaagtactacgtacgttccctccgtaggacgtctcgtacctcgtgtccgaccggccgtcgtcgaccgaccggcgttacttacttacgtggtaggacgacgtagtcgacgtaggtgggttcggttcgtccggacccccggtacgtacggggtcggggccgggacgtaacgttcgggttcggtaacccgtcccggttccttcccgtacgtacccgtccctacccgaaaccggggtacccggcccttaacgggtcccgtttccccctttcccgggccggtccccgtacctccgttaccnccggaaacggccgacccttacccggacgacggaccnccgaacgcccgggccccgtcggtcggggtacctcccggtacgtcgggtaaccgaaaacgggtttacccttacccgtttaaccacggtcggttacctccgttcggtaacggccgggtccgggtaacggtccgggaaccgtaacgggcccgtacgtaaacgg

SEQ ID NO: 364277 - DNA, 681 bp, Homo sapiens
  misc_feature: GZ8MTXP02FNS3D.4.6.A06.1.454.CMB.2.raw
tcagagcactgtagcacgaccggtgctcgatttagatctactgacagggtctcccaggccttgtgaagacctcggagaccctgtccctcacttgcactgtctctggtggctccatcagcagtttctagtggggcttggatccggcacgcccccgagggaagggactggaatggattgggaacacctattacagtgggacgcccagctacaactccctcctcaagacgtcgactcaccatcctcggctcgacccgtcaagaactcacgttcctccctgaggtctcgacctcgtcgtacgacccgccgcgtacgaccgaccggtccgttcttaacgtttaccgtggtcggggaagtaccgaggtcgacgtaggtgggttcggttccgtcggacccccccgtagtaccggtcggggcccgtaggtaacttccgtttcggggaccctacccggttccgttccctcgacggtccctacccgaacccgtaacgggcccctacgtcccggttcccttcccccgtggccccgtcccgttacgcctaccgagggcctaccgacccgtcgagacgaccacgacggccggaccgtgggcctcgcgtcgcgtaaacggtccttacctaccgttacacggttccgtacgtcgtacggaacggtcgggtcgtacgggacgacggtaccgagtacg

SEQ ID NO: 364278 - DNA, 760 bp, Homo sapiens
  misc_feature: GZ8MTXP02HZFT2.4.6.A06.1.454.CMB.2.raw
  modified_base (239)..(239): a, c, t, g, unknown or other
  modified_base (271)..(271): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcgtggggcccccggcagagggtcatcctctcttgttctggaggcagcctccaacntcggagacatcctgtgagctcggtaccaaccnccctccgaggaaccggcccccccaaactccctacactctaactacagtaattctaaacggacggccccgacgacgggggtccccaggtactcccggtacttccgtaccgtcggggtcccttccggtaggggttcccgttgggacccctacccgttccgtaaccgtcccccttcccgttcgttacccgtaactccgttaacggttacggggtacccgttccccggggtttccgtaggtaacggggtaacgtaccgggagggtccgttaacggtaacccgtttaactttaacggtttttcggttaccgttaagggggtaggttacgggggttaacttaaaccgtaccggtaccttaccgtagtacgtccgttcggtcgttcgggttaccgggacgggggtacggtaaccgaaacggttccgtaacccggttaacggtttaccgggaccgtaaccggccccggtaaacggtcccgtacccggttccccccgg

SEQ ID NO: 364279 - DNA, 662 bp, Homo sapiens
  misc_feature: GZ8MTXP02FIF8V.4.6.A06.1.454.CMB.2.raw
  modified_base (198)..(198): a, c, t, g, unknown or other
  modified_base (224)..(224): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcacctcagcgtcgcggggcccccggnaggagggtcactcctcttcttgttcnggaggcacgctaccaacagtcggacgacactcctgtgacgctacggtaaccaaaccacccctacccggaacggaaaccccgacccccaaaacgtccctcaacttctaataacaacgtactttaacaaacggaccggtccccgacggaaccggggtacacgatccgtaacttctcgacggtcctaccgtaagggttcctacgggacccttaccgcctaaccgtccccttcccgtacgtcccaatccgtacgtacggtacccgttccggtcgttacggaggtagtacgggtacgtaccgtacggtaccttaaagttacgttacggttacgagggtacgttacgggtaacttacgacgtactactgtacgccgtacgtcgtcggtacggtaggacgactaacgcgtaacgtgtacggactacgctaacgccaccgtacccg

SEQ ID NO: 364280 - DNA, 790 bp, Homo sapiens
  misc_feature: GZ8MTXP02IZGRV.4.6.A06.1.454.CMB.2.raw
  modified_base (140)..(140): a, c, t, g, unknown or other
  modified_base (205)..(205): a, c, t, g, unknown or other
tcagagcactgtagcacgaccggtgctcgatttagatctactgacagggggcttcagctgtgggtagagaagacaggactcaggacaatctccagcatggccagcttccctctcctcctcaccctcctcactcactgtgnaggtcctgggcccagtctgtcctgactcgaggctaccctcagcgtcgtcgggggccccccggganaggacgggtcacttcccttctcgtttgttcgtgggagcgacgcctaccaaacgagtacggggaacgactacgttacgtgtgacgtcgtacggtaacccaaacctacccgtacccgaacggaaccccgtacccccaaactccatactactaatacagtatacgtaaaggccggacccgacggacggtccaagtactaccgtattcctcgcgtacctaccgtacggtcgtcggccttacccgacctaccgtcccttaccctagttaccacgttacgtaacggttacggtaccgtacccggttacgtacgggaacggtacgtaacgggttacggtacgttacgttaaacgttaaccgtttaagtttacgttacggtacgggttaggttacggttaaacgttaacgtaacgaccgttaaacctaacgtttacgtaccggtaccggttacgttacggggtttaccgggggtaccgggtaaacggggtaaaccccgtaaaaccggttaccggtaacccggtttaaccgttaacggtaccggtaacccggtaaccccggtaaccgggtacccgtttacccggtaccccccgg

SEQ ID NO: 364281 - DNA, 531 bp, Homo sapiens
  misc_feature: GZ8MTXP01DJEYP.9.38.D05.1.454.CMB.2.raw
  modified_base (365)..(365): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaaacgcccccaaaactcttgctttatgatgtcagttatcggccctcaggagtttctgatcgcttctctggctcaagtctggccaccncggcctccctgaccatctctgggctcaggctgagacgaggctgattattctgcagctacaaaaaagagtagccctgtcgtggttttcggcgggggaccaaggtcgaccgtctaagttcagcccaaaggcttcgccccttggcactctcgtcccacctccttcaacg

SEQ ID NO: 364282 - DNA, 546 bp, Homo sapiens
  misc_feature: GZ8MTXP01D3CXH.9.38.D05.1.454.CMB.2.raw
  modified_base (359)..(359): a, c, t, g, unknown or other
  modified_base (411)..(411): a, c, t, g, unknown or other
  modified_base (508)..(508): a, c, t, g, unknown or other
tcagtgatacgtctcacgaccggtgctcgatttagtatctgatagttgggtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaaacaataccccggcaaacgcccccaaaatcttgctttatgatgtcagttatcggccctcaggagtttctgatcgcttctctgctcaagtctggcacncggcctccctgaccatctctgggctccaggctgagacgaggctgattattcngacagacgtaaacgaaaagtacgtacgtccctcgtcggttcgggtttcggggcggggtactaaggtcgaccgtaactaagcgacgaccgaaggtccnccgccccgttcgtctactctcgtccactcccttcgtcg

SEQ ID NO: 364283 - DNA, 528 bp, Homo sapiens
  misc_feature: GZ8MTXP01EGB4X.9.38.D05.1.454.CMB.2.raw
  modified_base (496)..(496): a, c, t, g, unknown or other
  modified_base (508)..(508): a, c, t, g, unknown or other
  modified_base (523)..(523): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaaactatgtctcctggtaccaacaataccccggcaaaagcccccaaactcttgctttatgatgtcagttatcggccctcaggagtttctgatcgcttcctctggctccaagtctggcaccacggcctccctgaccatctctgggctccaggctgaggacgaggctgattattctgcagctacaaaagagtagccctgtcgtggtttcggcgggggaccaggtgaccgttctaagttcgagccaaggcncgcccctggtcncgtcttcgttccccncctcc

SEQ ID NO: 364284 - DNA, 534 bp, Homo sapiens
  misc_feature: GZ8MTXP01D3F1B.9.38.D05.1.454.CMB.2.raw
  modified_base (520)..(520): a, c, t, g, unknown or other
tcagtgatacgtctcacgaccggtgctcgatttagtatctgatagtttggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaaactatgtctcctggtaccaacaataccccggcaaaagccccaaactcttgctttatgatgtcagttatcggcctcaggagtttctgatcgcttcctctggctccaagtctggcaccacgcctcctgaccatctctgggctccaggctgaggacgaggctgattattctgcagctaacaaaaagagtaacgcctcttcggtggttttcgggcgggggaccaagggtcgaccgttctaaagttcgagcccaaggcttcgcccctgtcactcncgttcccgccgtcc

SEQ ID NO: 364285 - DNA, 573 bp, Homo sapiens
  misc_feature: GZ8MTXP01EBF0L.9.38.D05.1.454.CMB.2.raw
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtaattaactatgtctcctggtacccaaacaactaccccggacaaaacgcccccaaactccttgctttatgatgtcagttatcggccctcaggtagtttctgatcgctttcctctggctccaagtctggcaccacggccctcctgaccatctcgtggctcgaggctgaggacgaggctgattatttcgtgcaagctaaacaaaaagaagtacgcccgtcgtcggttggtttccggggcgggggtaacaagggtcgaccgttacgtaaacgttcgaacgcccgaagggccttcgcccctggtccacgtcttcgtttccccaacccgttccc

SEQ ID NO: 364286 - DNA, 522 bp, Homo sapiens
  misc_feature: GZ8MTXP01C7191.9.38.D05.1.454.CMB.2.raw
  modified_base (357)..(357): a, c, t, g, unknown or other
  modified_base (439)..(439): a, c, t, g, unknown or other
  modified_base (499)..(499): a, c, t, g, unknown or other
tcagtgatacgtctcacgaccggtgctcgatttagtatctgatagttgagtttggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctcctggctccaagtctggcnccacggccctccctgacccatctctgggctccaggctgaggacgaggctgattattctgcaggctacaaaagagtagccctntcgtggtttcggcgggggacaggtgaaccgtcagtcagcccaaggcttcgcccctggtcnctctcgttcccaacccttctccg

SEQ ID NO: 364287 - DNA, 542 bp, Homo sapiens
  misc_feature: GZ8MTXP01AJ467.9.38.D05.1.454.CMB.2.raw
  modified_base (269)..(269): a, c, t, g, unknown or other
  modified_base (365)..(365): a, c, t, g, unknown or other
  modified_base (506)..(506): a, c, t, g, unknown or other
  modified_base (532)..(532): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaanaccccggcaaacgccccccaaactcttgctttatgatgtcagttatcggccctcaggagtttctgatcgcttctctcggctcaagtctggcacccncggccctccctgaccatctctgggctccaggctggaggacgaggctgatttattctgcagctacaaaaagagtacgcccttcgtcggttggtttcgggcgggggtaccaaggtcgaccgtctaagttcacgcccgaaggcncgccccttgctcaactctcgttcccncccttcctcg

SEQ ID NO: 364288 - DNA, 539 bp, Homo sapiens
  misc_feature: GZ8MTXP01AXSRI.9.38.D05.1.454.CMB.2.raw
  modified_base (298)..(298): a, c, t, g, unknown or other
  modified_base (329)..(329): a, c, t, g, unknown or other
  modified_base (356)..(356): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctctggtaccaacaataccccggcaaacgccccaaactcttgctttangatgtcagttatcggccctcaggtagtttcngatcgcttctcctggctcagtctggcnccacggccctccctgaccatctctgggctccgaggctggaggacgaggctgattattctgcaggctaacaaaaagagtacgcccctgtcgttgggtttccggggcgggggtacaagggtgaaccgtcgaagtcagcccaaggcttcgcccctggtcaactcgtcgttccccgtccttccgtcg

SEQ ID NO: 364289 - DNA, 525 bp, Homo sapiens
  misc_feature: GZ8MTXP01EZ4UQ.9.38.D05.1.454.CMB.2.raw
  modified_base (300)..(300): a, c, t, g, unknown or other
  modified_base (359)..(359): a, c, t, g, unknown or other
tcagtgatacgtctcacgaccggtgctcgatttagtatctgatagttgggtttggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttangatgtcagttatcggcctcaggagtttctgatcgcttctctggctcaagtctggcaccncggcctccctgaccatctctgggctcaggctgaggcgaggctgattattctgcagctacaaaaagagtagccctcgtcgttggtttcggcgggggtacaaagggtgaccgtctaagttcagcccgaagcttcgccccttggcactctcgtcccacctccttcaacg

SEQ ID NO: 364290 - DNA, 610 bp, Homo sapiens
  misc_feature: GZ8MTXP01EC9YK.9.38.D05.1.454.CMB.2.raw
  modified_base (374)..(374): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattgtattaactatgtctctgtaccaacaacaccccggacaaacgcccccaaactcttgtcttatgatgtctagttactccggccctcgaggtagtttctgtatcgtcttctctcggctcaagtctcggaccacccnccggtccctccctcgaccctatctcgtcgggcctccgaggctaggacggacgtaggtcttgtatttattctgacagtactaaacgaaaaaggtacgtaacgtcccttcgttcggttcggggtttcggggacgggggtaacctaggtcgtaccgtaactaacgttcgacgcccgaaggtccttcccggccccgttcggtcctaccgttccttccgtccccaccctcccttcgaaccg

SEQ ID NO: 364291 - DNA, 549 bp, Homo sapiens
  misc_feature: GZ8MTXP01BZSPT.9.38.D05.1.454.CMB.2.raw
  modified_base (368)..(368): a, c, t, g, unknown or other
  modified_base (386)..(386): a, c, t, g, unknown or other
  modified_base (420)..(420): a, c, t, g, unknown or other
  modified_base (524)..(524): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaaacaactaccccggacaaacgcccccaaactcttgctttatgatgtcagttatcggccctcaggtagtttctgatcgcttctctcggctcaagtctggcaccncggcctccctgaccatcnctgggctcaggctgaggacgaggctgattattcngtcagactacaaaaagagtacgccctgtcggtgggttttcgggcgggggtaccaaggtcgaccgtcgtaagttcgacgccgaaacggcttcgccccttggtccnctctcgttcccaccctccttcaacg

SEQ ID NO: 364292 - DNA, 544 bp, Homo sapiens
  misc_feature: GZ8MTXP01BOVNW.9.38.D05.1.454.CMB.2.raw
  modified_base (266)..(266): a, c, t, g, unknown or other
  modified_base (274)..(274): a, c, t, g, unknown or other
  modified_base (357)..(357): a, c, t, g, unknown or other
  modified_base (518)..(518): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctctgtacaacaanaccccggnaaacgccccaaatctgctttatgatgtcagttatcggcctcaggagtttctgatcgcttctctcggctcaagtctggccaccncggccctccctgaccatcctcgtcgggctccgaggctggaggacgaggctgtattattctgcagctacaaaaagatagccctgtcgtggtttcgggcgggggtacctaaggtcgaccgtctaaagttcacgcccgaaagggtcttacgccccttcggtccncgtctcgtcccgccctccttcgaacg

SEQ ID NO: 364293 - DNA, 642 bp, Homo sapiens
  misc_feature: GZ8MTXP01DUFIX.9.38.D05.1.454.CMB.2.raw
  modified_base (436)..(436): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaaccagcagtgactattggtattaaactatgtctcctaggtaccaaacaactaccccggacaaaacgcccccaaactcttgtctttatgatgtactagttatccggtccctcgtaggtacgtttctgtactcgtcttcctctggctccagtctcgccaccgtaccggccctccctgacctatctcgtggcctccgagctggacggacgngctgtattcttctgacgtaagtactaaaccgaaaaagtacgtacgtcccgttcgttacgggtttcggggtttcccggggacgggggtaacctaaggggtccgtaacccggttacgtaaacggttccgtaacggtcccgaaacgggttcccttacccggtcccccttcgggtcctacctccgttcccgttccccgaaccccttcccg

SEQ ID NO: 364294 - DNA, 566 bp, Homo sapiens
  misc_feature: GZ8MTXP01EZOEY.9.38.D05.1.454.CMB.2.raw
  modified_base (227)..(227): a, c, t, g, unknown or other
  modified_base (267)..(267): a, c, t, g, unknown or other
  modified_base (276)..(276): a, c, t, g, unknown or other
  modified_base (298)..(298): a, c, t, g, unknown or other
  modified_base (366)..(366): a, c, t, g, unknown or other
  modified_base (437)..(437): a, c, t, g, unknown or other
  modified_base (441)..(441): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccatctcctgcactggaaccngcaagtgacattggtattaactatgtctctggtacaacanaccccgganaaacgccccaaatctgctttangatgtcagttatcggcctgaggtagtttctgtattcgtcttctcgtcggcctcaagtctggaccaccncggcctcctgaccatctcgtcgggactccgaggctagaggacgagctgtattattctgacagctactatancganagtcgtgtacacgtcgtcgtggtacgtcgggacgggttacgggtaccgttaggtccgtaccggttccgttcgggaccgaacggtacccgaacggtcccgtcccggccccgtccggttcctaaccg

SEQ ID NO: 364295 - DNA, 597 bp, Homo sapiens
  misc_feature: GZ8MTXP01CNBE3.9.38.D05.1.454.CMB.2.raw
  modified_base (281)..(281): a, c, t, g, unknown or other
  modified_base (306)..(306): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggnaaacgcccccaaactcttgctttangatgtcagttatcggccctcaggtatttctgatcgcttcctctggctccaagtctggcaccacggcctccctgacctatctctggctcgagctgaggacgaggctgattattcgtgcgagactaacgaaaaagacgtaacgcccttcgtacggttcgggtttccggggacgggggtaacctaagggtcggtaacccgttaccgtaacggttccgaacggcccgaagggttcccttaccggtcccccgttacggtccctacgttcccgttccggttccccgccccgttcccg

SEQ ID NO: 364296 - DNA, 610 bp, Homo sapiens
  misc_feature: GZ8MTXP01B27M9.9.38.D05.1.454.CMB.2.raw
  modified_base (311)..(311): a, c, t, g, unknown or other
  modified_base (331)..(331): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaacccaacaactaccccggacaaacgcccccaaactcttgtctttangatgtcagttatcggccctnaggtatttctgatcgtcttcctcgtggctcccaagttcctcggccacccgacggccctccctcgaccatctcgtggcctccgaggctggacggtacggaggctagtattattctgcgagctaacaaaagtagtacgtcccgtcgttcggttcgggttttccggggacgggggtaccaacggggtcgtacccggttccgtaaacgttcgaaccgcccgaacggttccttccggcccccgtcggtcctaccgttccgttcccgttccccaacccgttcccg

SEQ ID NO: 364297 - DNA, 675 bp, Homo sapiens
  misc_feature: GZ8MTXP01D44I9.9.38.D05.1.454.CMB.2.raw
  modified_base (326)..(326): a, c, t, g, unknown or other
  modified_base (370)..(370): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaaacaactaccccggacaaacgccccccaaactcttgctttatgatgtcagttatcggcctnaggtagtttctgatcgtcttctctcggctcaagtctggccaccncggccctccctgaccatctcgtcgggcctcgaggctggaggacgaggcttagtatttattctgcaagtactaaactaaaaaagtaacgtacgtccccttcgttacgggttcggggtttttaccgggggaccggggggtaaccgtaaacggggttccggtaacccggttaaccgttaaacggttaccgaaccgggaccccgaaacgggtcccttacccgggttcccccccgttccggggttccctaacccgtttcccgttcccggtttaccccccttaaccccgttcccttaaccgtaaacccggg

SEQ ID NO: 364298 - DNA, 565 bp, Homo sapiens
  misc_feature: GZ8MTXP01CZABY.9.38.D05.1.454.CMB.2.raw
  modified_base (274)..(274): a, c, t, g, unknown or other
  modified_base (358)..(358): a, c, t, g, unknown or other
  modified_base (418)..(418): a, c, t, g, unknown or other
  modified_base (540)..(540): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctctggtaccaacaataccccggnaaacgcccccaaatcttgctttatgatgtctagttatcggccctcaggtagtttctgatcgcttctctggctcaagtctcggcnccacggccctccctcgacccatctctgggctccaggctgaggacgaggctgtattattcngtcagggtactaacgaaaaaagtacgtaacgcccctcgttcggttggggtttccggcggggggtaccagggtcgaacccgtcttaaggtcagtcccgaaggccgttccgcccctcggtaccnctcgtcttcccaaccttcctaaccg

SEQ ID NO: 364299 - DNA, 684 bp, Homo sapiens
  misc_feature: GZ8MTXP01CJ6C7.9.38.D05.1.454.CMB.2.raw
  modified_base (225)..(225): a, c, t, g, unknown or other
  modified_base (301)..(301): a, c, t, g, unknown or other
  modified_base (315)..(315): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccngcagtgactattggtaattaactatgtctctaggtaccaacaactaccccgacaaacgccccaaactctgctttangtatgtcagttacncgccctcgaggttagtttctgtactcgtcttctcctggctacaacgtcgtcgggacccaacccgaccggtcccctcccgtacgaccctaacgttcctccgtacggggtcctcccggagggccgttagggaacggacgggtaacggtcctaggttatttacgtttccgtacgtacgtaacggtaacgtaaaacgtaaaacggtacgttaccgtcccgttcggttcgggtttacggggttaccggggaccggggtaacgtaacgggtccggtaaccgttacgaacgtccgaccggtaccgtacgttccgttcccgttccccgttcgtccttaaccgttccgtacccgttacccctaacccgttccgtaacg

SEQ ID NO: 364300 - DNA, 627 bp, Homo sapiens
  misc_feature: GZ8MTXP01DMPPE.9.38.D05.1.454.CMB.2.raw
  modified_base (229)..(229): a, c, t, g, unknown or other
  modified_base (465)..(465): a, c, t, g, unknown or other
tcagtgatacgtctcacgaccggtgctcgatttagtatctgatagttggggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccngcagtgactattggtaattaactatgtctctaggtaccaaacaactaccccggacaaacgacccccaaactcttgtactttatgtatgtctagttactccggccctcaggtacgttttctgtatccgtcttctcgttcggcctactaagtcctcggacccacccgccggccctcccgtcgacctactctcgtcgggcctcgaggtcaggaggtacgagggtctgtactttattcgngacagtcgtaaactaaaaggtaacgtacgtccctcgttcggttcggggtttcggggacgggggtacctaagggtccgtaccgtcgtaaacgttcgacgccgtaacgccgttccgccccttggtaacctcgtccgttccgtcccggttccctcgttcgtaacg

SEQ ID NO: 364301 - DNA, 700 bp, Homo sapiens
  misc_feature: GZ8MTXP01A9QBJ.9.38.D05.1.454.CMB.2.raw
  modified_base (465)..(465): a, c, t, g, unknown or other
tcagtgatacgtctcacgaccggtgctcgatttagtatctgatagttggggtttggggggggtctcaggaggcagcgctctcgggacgtctccaccatggcctgggctctgctattcctcaccctcctcactcagggcacagggtcttggacccagtctgccctgactcaacctgcctccgtgtctgggtctcctggacagtcgatcaccatctcctgcactggaaccagcagtgactattggtaattaactatgtctcctggtaccaacaacaccccggacaaacgccccaaatcttgctttatgatgtctagttatccggccctcgtaggtagtttctgatccgtcttcgtctcggcctcgtaagtcgtcgaaccacccgaaccggtccctcccgtagaccctatccgtcgtcgggcctccgtacggcgtaggacggacggaggtcttagtactttatttcgngacgtagtaacgtaaacgaaaaaacggtacgttaacgtccccgttacgtttcggggttacggggttttaccgggggaccggggggtaaccctaagggtaccggtaacccgttaaccgtaaacggttaccgtaaccggaccccgtaacgggcccgttcccggttccccccggttacggtcccctaccgttcccgtttcccggtacccccttaccccgtcccttaaccgtaacccgg

SEQ ID NO: 364302 - DNA, 625 bp, Homo sapiens
  misc_feature: GZ8MTXP01EKREC.9.38.D05.1.454.CMB.2.raw
  modified_base (304)..(304): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtaattaactatgtctctagtaccaacaactaccccggacaaacgaccccaaactcttgtctttangatgtctagttatccggccctacgaggttagtttctgtactcgtcttctccgtcggtcctaccgtaagtcgtacgggcccaaccgaccggtccctccctacgacctactctcgtcgggctccgagcgtgaggacgaggtctgtattacttctgcacggtactaaacgaaaaagtacgtacgtcccgtcgttcggttacggggtttccggggacgggggtaaacctaacgggtcgaaccgtaccgttaagtccgacgacccgtaacggccgttccgccccgtcggcctaaccgttcctccgttccccgtcccgttcctaacg

SEQ ID NO: 364303 - DNA, 703 bp, Homo sapiens
  misc_feature: GZ8MTXP01DHD39.9.38.D05.1.454.CMB.2.raw
  modified_base (248)..(248): a, c, t, g, unknown or other
  modified_base (297)..(297): a, c, t, g, unknown or other
  modified_base (311)..(311): a, c, t, g, unknown or other
  modified_base (323)..(323): a, c, t, g, unknown or other
  modified_base (327)..(327): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtattaactntgtctctgtaccaacaactacccgacaaacgccccaaatcttgctttangatgtacagttacncgtcctgaggtnttcngactcgcttctcgtggctacaagtctacgcaacccgaccggtccctcccgtcgacctacgtctcgtcgggcctaccgaggtctggacggacggtacgggtcttacggtaatttacgttcgtcggtacctaacgggtactaaaacgtaaaaaacgtaacggttaaccgtccccgtttacggttccgggttttaccgggggttttccgggggacccggggggttaaacccgtaaacggggttcccggtaaaccccggttaccgttaaacggttccgaaacccggtaccccgtaacgggttcccgttcccggttcccccgttcgggttaccctaaccgtttcccgtcccggttccccccggtccccttcccgtaacccg

SEQ ID NO: 364304 - DNA, 580 bp, Homo sapiens
  misc_feature: GZ8MTXP01BF4MY.9.38.D05.1.454.CMB.2.raw
  modified_base (308)..(308): a, c, t, g, unknown or other
  modified_base (574)..(574): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtattaactatgtctcctggtaccaacaactaccccggacaaacgcccccaaatcttgctttangatgtctagttatcggccctcgaggtagtttctgtatcgtcttcctctggctccaagtctggccaccgaccggccctccctcgaccattcctcgtcggggcctccgagggcctggaacgggaccgtaggtcgtgtatttacgttctgcgagtactaacaaaaaggagtacgcccgttgttcggttgggtttccggggcgggggtaccagggtcgacgttcgtaagcgacgccgacgcttccgcccctggtccactcttccgtcccnccgtcc

SEQ ID NO: 364305 - DNA, 726 bp, Homo sapiens
  misc_feature: GZ8MTXP01A34X7.9.38.D05.1.454.CMB.2.raw
  modified_base (303)..(303): a, c, t, g, unknown or other
tcagtgatacgtctcacgaccggtgctcgatttagtatctgatagctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatcctccgcactacgaacgacgcacgtagacattagttagttaactatgtctcctcgtacaacaactaacccgaccaacgaccccaacctacttcgtcttatanatgtctagtagtcgcccgtacgtaggtagtttctgtatcgtcttctcgtcgtcctccacgtacgtcgaccaacccgaccgtcccgtccctacgacctactcgtcgtcgggtcctaccgtacgggcgtggaacggggaaccggtaagggtcttagttaattttgtttacgcgactaaacggtacttaaaaccgggtaaaaaaaggaaacggtttccgtacccccgtttcggttccgggggtttcgggggttttacccggggggaaccgggggggaaaccccttaaaggggtcccggttaaccctacccgggttaaagtcccggaccggtaaccccggaaacgggtccgtccccggttaccccccgtttcggacctaacttcccgtttcccgttccccaccccggttcttcccgaagttaacccg

SEQ ID NO: 364306 - DNA, 666 bp, Homo sapiens
  misc_feature: GZ8MTXP01BI4XU.9.38.D05.1.454.CMB.2.raw
  modified_base (374)..(374): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaactaccccggcaaacgcccccaaactcttgctttatgatgtcagttactccggccctcgtaggtagtttctgtatcgtcttctctcggctcaagtctggaccaccncggccctccctcgaccatctcgtcgggcctccgaggcgtaggacggtacgaggtcttagtatttattctcgactagacttaaacgaaaaaggtacgtaacgtcccttacgttcgggttcggggttttaccgggggaccggggggtaaccgtaaaggggttccggtaaccccggttaaccgttaaacggttccgtaaccggaccccgtaaacgggtcccgttacccggttcccccgttcgggtccctaccgttccgttcccgttccccggccccttaaccgttccgtaaccgg

SEQ ID NO: 364307 - DNA, 611 bp, Homo sapiens
  misc_feature: GZ8MTXP01CUXRE.9.38.D05.1.454.CMB.2.raw
  modified_base (268)..(268): a, c, t, g, unknown or other
  modified_base (276)..(276): a, c, t, g, unknown or other
  modified_base (299)..(299): a, c, t, g, unknown or other
  modified_base (329)..(329): a, c, t, g, unknown or other
  modified_base (359)..(359): a, c, t, g, unknown or other
  modified_base (380)..(380): a, c, t, g, unknown or other
  modified_base (417)..(417): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctctgcactggaaccagcagtgacattggtattaactatgtctcctggtaccaacaanaccccggnaaacgccccaaatcttgctttangatgtcagttatcggcctcaggtagtttcngtatcgcttctctcggctcagtctgcaccncggcctcctagaccatctcgnggctccgaggctgacggacgagtctagatttattcgngacagtacgtaaacgaaaagtacgtacgtacccgttcgttcgggtttcggggtttaccggggacggggtaaccgtaacgggtccgtaaccgtaacgtaacggaccgtaacgacccgtaacggtcccttcccggttccccgttcggtcctaccgttccgttcccgttaccccttacccttcccgttaacgtaacg

SEQ ID NO: 364308 - DNA, 568 bp, Homo sapiens
  misc_feature: GZ8MTXP01BDX1P.9.38.D05.1.454.CMB.2.raw
  modified_base (540)..(540): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtattaactatgtctcctggtaccaacaataccccggcaaacgcccccaaatcttgctttatgatgtctagttatcggcctcaggtagtttctgattcgcttctctcggctcagtctggaccaccgcggccctcctgaccatctcgtggctcgaggctgaggacgagctgattattctgcagactaacaaaaaggtacgtacgtccctcgtcggttcgggttttccggggacgggggtaccgaagggtcgaccgtaacgtaaagcctacgcccgaacgcttaccgccccgttcggtaacnccgtcttcgtcccgccctcgttcaacgg

SEQ ID NO: 364309 - DNA, 558 bp, Homo sapiens
  misc_feature: GZ8MTXP01CBJRT.9.38.D05.1.454.CMB.2.raw
  modified_base (381)..(381): a, c, t, g, unknown or other
  modified_base (526)..(526): a, c, t, g, unknown or other
  modified_base (544)..(544): a, c, t, g, unknown or other
  modified_base (552)..(552): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctctggtaccaacaactaccccggacaaacgcccccaaactcttagctttatgatgtctagttatcggccctcaggagtttctgatcgtcttcctctggctccaagtctcggcacaccgcctccngaccatctctcggctcgaggtctggacggacggagctgtattattctgcagtctaacgaaaaagagtaacgccctgttaccggttgggtttccggggcgggggtaccgaagggtcgaacgttccgtagttcgacgcccgaaggcncgcccctcggtcacgtcncgttcccncctccc

SEQ ID NO: 364310 - DNA, 715 bp, Homo sapiens
  misc_feature: GZ8MTXP01BPMY7.9.38.D05.1.454.CMB.2.raw
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctgtaccaacaactaccccggacaaacgccccaaactctgtctttatgatgtcagttactcggcctcgaggtagtttctgatcgtcttctctcggctacgtaagtcctggtaccacccgccggtccctcccctcgaccctattccgtcgtcgggcctacccgaggtcgtggaacggacggtaagggtccttaggtactttacgtttcgtgtacacggtactaaacgaaaaaaggtaccgtaacggtcccttacggttccgggtttacggggtttacccgggggaccggggggtaaaccgtaacggggttccgtaaccccgggttaaccgtaaacggttcccgtaacggacccccgtaaaggggtccccttacccggttccccccggttccgggtaacccctacccgttcccgtttaccccgggttcccccggttccccgttcccgttcccgtaaaccgg

SEQ ID NO: 364311 - DNA, 604 bp, Homo sapiens
  misc_feature: GZ8MTXP01DI7BM.9.38.D05.1.454.CMB.2.raw
  modified_base (360)..(360): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtaattaactatgtctctggtaccaacaactacccggcaaacgccccaaatcttgctttatgatgtcagttactcggcccctgaggtagttctgatcgcttctctggctcaagtctcggacnccgacggtccctccctcgaccactctctcgggctcgagctggaggacgaggctgtattattcgtagcagggtactaagaaaaacggtacgtaacgtccccgttcgtcggtttggggttttaccggggcggggggtaacctaaggggttcgaacccgttaccgttaagtccgaacgacccgaaggcccgttccgcccccgttcggtactccgttcctccgttcccctaaccccgttccgtaaccg

SEQ ID NO: 364312 - DNA, 636 bp, Homo sapiens
  misc_feature: GZ8MTXP01C7MAF.9.38.D05.1.454.CMB.2.raw
  modified_base (370)..(370): a, c, t, g, unknown or other
  modified_base (384)..(384): a, c, t, g, unknown or other
  modified_base (421)..(421): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaaacaactaccccggacaaacgcccccaaactcttgtctttatgatgtcagttatcggccctcaggtacgtttctgatcgtcttctctcggctacagtctgcaccncgcctccctgaccntctcgtggcctcgaggcgtagaggacgagctgtattnttactgacagtacgtaacaaaaaggtaacgttacgacccttcgtcggtttcgggttttaccggggacgggggtaaccgtaagggtacgtaccgtaaccggtaacgttccgtacgttacccgaaacgggtccttacccgggttcccccgttacgggttcccgtaacccgttccgttcccggttaacccccacccctttcccttaacgtaacccggg

SEQ ID NO: 364313 - DNA, 653 bp, Homo sapiens
  misc_feature: GZ8MTXP01A4O66.9.38.D05.1.454.CMB.2.raw
  modified_base (230)..(230): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccatctcctgcactggaaccngcagtgactattggtattaactatcgtctcgtgtaccaacaactacccggacaaacgccccaaactcttagtctttatgtatgtcagttactccggtcctacgtaggtagtttctgtactcgtctttcccgtcgtcggtctccgaagttcctacgggcctacccgtaccgggtccctccccgtacgacctactcctcgtcgggcctacgacgtcgtaggacggacgagtcgtagtattatttctggctagtacgtaaacgaaaacgtacgtacgtcccgttcggtacgggtttggggtttaccgggggacgggggtaccgtaacggggtcgtaacccgttacgtaacggttccgacgcccggttaacggccttacccgtccccgtcggtcctacgtccttcccggttccccttcccctaaccg

SEQ ID NO: 364314 - DNA, 592 bp, Homo sapiens
  misc_feature: GZ8MTXP01D41ZT.9.38.D05.1.454.CMB.2.raw
  modified_base (227)..(227): a, c, t, g, unknown or other
  modified_base (304)..(304): a, c, t, g, unknown or other
  modified_base (373)..(373): a, c, t, g, unknown or other
  modified_base (433)..(433): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcacatctcctgcactggaaccngcagtgacattggtaattaactatgtctcctggtaccaaacaacaccccggacaaacgcccccaaatcttgctttangatgtcagttactcggccctcgaggtagttttctgattcgtcttctctcggctcaagtctggaccaccncggcctccctcgacctatctcgtcgggctcgaggcgtgaggacgaggctgtattattcgngactagacttaaacaaaaaggtacgtacgtccctgttcggttgggtttacggggcgggggtactaggtcgccgtaactaagcgacgttccgaacggtccttaccgttccccgttcggtccaccgttccgttccgtccccgcccttccgttcgtaaccgg

SEQ ID NO: 364315 - DNA, 723 bp, Homo sapiens
  misc_feature: GZ8MTXP01BN9K7.9.38.D05.1.454.CMB.2.raw
  modified_base (251)..(251): a, c, t, g, unknown or other
  modified_base (309)..(309): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctcgtgtctgggtctctggacagtcgatcaccatctcctgcactggaaccagcagtgactattaggtaattaactntcgtctcctggtaccaacaactaccccggacaaacgaccccaaactcttgtctttatnatgtctagttactccggtacctcgaggtactttctggtattcgtctttctcgtggcctctaagtctcgaccgacccgcggtccctacccgtcgaccctacttccgtcgtcggggtccctccgaacggtcgtacgggaacgggtacggacgggtccttaggtactttaagtttcgtacggtactaacggtacgtaaacgaaaaaaacggtacggttaaaccgttcccccggttacggtttaccgggtttacgggggttacccgggggttaccgggggaaccggttaacgggtacccgttaccgtaaacggttacgaccgaaccgttaccgggtaaccgtccgttaccccgttcccggttaccgtccgtaccgttccgttccccgtacccgttacccttaaccgttaacgtaaccg

SEQ ID NO: 364316 - DNA, 593 bp, Homo sapiens
  misc_feature: GZ8MTXP01EC4KI.9.38.D05.1.454.CMB.2.raw
  modified_base (262)..(262): a, c, t, g, unknown or other
  modified_base (295)..(295): a, c, t, g, unknown or other
  modified_base (301)..(301): a, c, t, g, unknown or other
  modified_base (414)..(414): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccatctcctgcactggaaccagcagtgactattggtaattaactatgtctctgtaccangcaccagacaaacgtccccaaatcatgtattangagtanaatagccgccctcgtcgggtccctgactccgtcttcctacgtcggctacccgtaagtccgtacggccaaaccgacccggtccctccctcgtacccgtctcgtcgggctaccgnggctagacagtgacggtctgtaattacgtacgtcgactggtccttagattacgcggaccaacggaccaaccctacgtaaagtcgtacgttaacgggaaggttcggggaaccttaccggtccgtaaccgttcgttacggacaaccgacccgaacgaccccaccgctaagttccgtaaccg

SEQ ID NO: 364317 - DNA, 701 bp, Homo sapiens
  misc_feature: GZ8MTXP01CLMHM.9.38.D05.1.454.CMB.2.raw
tcagtgatacgtctcacgaccggtgctcgatttagtatctgatagttggggtttgggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctctgcactggaaccagcagtgactattgtaattaatatgtctcctggtaaccaacaacgaccccgacaaacgacccccaaactcttgctttatgatgtctagttacgtccgcctcgtaggtagtttctgtattcgtcttcgtctcggcctactaagtctcggaacccaaccgccggtccctcccgtacgaaccctattcccgtcgtacggggtcccttaccgacgggttacgacgggaacgggaaccggtaacgggtcctttaggtaattttaacgttcgttaagcgtaacgtaaccggtaaaagtaaaaaacggtaacgtaccgtcccgttaaccgttcgggttcggggtttaacccgggggcgggggtaaccgtaacgggtacgtacccggttaacgttaacggacctacggcccgtaaacggtccttaccggttccccttacggtccgacttcccgttccgtccccttacctcccgttcaaccg

SEQ ID NO: 364318 - DNA, 705 bp, Homo sapiens
  misc_feature: GZ8MTXP01COA8P.9.38.D05.1.454.CMB.2.raw
  modified_base (226)..(226): a, c, t, g, unknown or other
  modified_base (347)..(347): a, c, t, g, unknown or other
  modified_base (383)..(383): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctctgcatggaaccngcagtgactattaggtaattaactatgtctcctacggtaaccaacaacgtaccccgacaaccgacccccaaactcttgtctttatgtatgtactagttactccggcctacgaggtgtttcngtactcgtcttctcgtcgctcagtctcggaccaccnccgtccctccctacgacctcgtctcgtcggtctaccgaggcgtaggacgggacgaggtccttaggtactttacgttcgtgacgtagtaaccgtaaacgtaaaaacggtacttaaccggtccctttcggttcggggtttcggggtttaccgggggacgggggtaaacccggtagggttaccgtacccgggttaacgttaaacgttcccggaaaccggttaccccggtaaacggtccccgttacccggttcccccgttaccgggttaaccctcccggttcccgttcccggttcccccgcccgtttcccgttaacccgtaaccgg

SEQ ID NO: 364319 - DNA, 646 bp, Homo sapiens
  misc_feature: GZ8MTXP01EH4IL.9.38.D05.1.454.CMB.2.raw
  modified_base (405)..(405): a, c, t, g, unknown or other
tcagtgatacgtctcacgaccggtgctcgatttagtatctgatagttggggtttgggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcacatctcctgcactggaaccagcagtgactattggtaattaactatgtctctaggtaaccaacaacaccccggacaaacgccccaaactctgtctttatgatgtactagttactccggacctcgaggttagtttctgtacttcgtcttctcgtcgcctacgagtcgtcgaccacccgcggtccctccctcgaccctnttcgtcgtcgggcctaccgaggtcgtaggagggacgtaggtcttaggtatttacgttctagacaacgtaactaaaggtaaaacgtacgtacgtccgttacggttcgggtttaggggtttaccgggggacggggttaaccgaagggttccgtaaccggtcgtaaagttccgaaccgttccgacggtccttcccggcccttcggccttacgtccgttccgtccccgttcctccgttcgtaacg

SEQ ID NO: 364320 - DNA, 740 bp, Homo sapiens
  misc_feature: GZ8MTXP01CYVAY.9.38.D05.1.454.CMB.2.raw
  modified_base (269)..(269): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctctgcactggaaccagcagtgactattggtaattaactatgtctcctggtaaccaanaaactaccccggacaaaacgccccctaaaactcttgacctttatgtatgtctagttacgtccggtccctgtaggtatttctggtactcgtcttctcgtccggtctactaagtctcggtaccacccgaaccggtccctaccctacgtaccctactccgtcgcggggtccttcgaggtccaggacgggacgaacggtcgtaggtattaacttcgtggactacggtaacttaaacgaaaaaaacggtaacgttaaaccgtcccttaccggtacggttttcgggggttttaccgggggacccgggggtaaccgtaaacgggtcgtaacccggtttaaccgtaacgttacccgtaacggaccccgtaaacgggtcccgttccccggttcccccggtttcccgggtaacctaaccccgtttcccttaccccgggtttcccccttaaccccgtttccccgttaaccgggttaaacccg

SEQ ID NO: 364321 - DNA, 803 bp, Homo sapiens
  misc_feature: GZ8MTXP01B6TI6.9.38.D05.1.454.CMB.2.raw
  modified_base (225)..(225): a, c, t, g, unknown or other
  modified_base (429)..(429): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccngcagtgactagttggtattaactatgtctctacggtaaccaacaactaccccggacaaacgtaccccccaaaacttcttcgaccttttaatgattcgtactacgttaactccggtccccttacgtaacgggtagttttccgtaggtacttccggtccttttcctcccgttcgggacctttcccgaaacgttcgttcgggacccncccgaaacccggggtccctccccgtcggtaccctaacgttccgttcggtacggggtccttccccgtaaggccgttacgggaacggggaacccggtaaaggggtcctttacggtaagtttaactttttcccgtaggaccttaacggggtactttaaaacgaaaaaaacggtacgttaaaccggtccccgttaaccggtttacgggtttcggggttttaccggggaccgggggggtaacccttaacgggggtacggtaaccggttaccgttaaaacggttccacggttaacccgaacgggttcccgttaaccgttccccgttccgggtcccaaccgtttcccgttccgttaccccggtcccttaaccctaacccgg

SEQ ID NO: 364322 - DNA, 520 bp, Homo sapiens
  misc_feature: GZ8MTXP02GAWGI.9.38.D05.1.454.CMB.2.raw
  modified_base (360)..(360): a, c, t, g, unknown or other
tcagtgatacgtctcacgaccggtgctcgatttagtatctgatagttgggtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaaactcttgctttatgatgtcagttatcggcctcaggagtttctgatcgcttctctggctccaagtctggcaccncggcctccctgacccatctctgggctcaggctgaggacgaggctgattattctgcagctacaaaaagagtagcctctcgtggtttcggcgggggaccaaggtgacgtctaagtcacgcccaaggctcgcccctcggtcactctcgtcccacctcctcacg

SEQ ID NO: 364323 - DNA, 524 bp, Homo sapiens
  misc_feature: GZ8MTXP02GCJ0K.9.38.D05.1.454.CMB.2.raw
  modified_base (328)..(328): a, c, t, g, unknown or other
  modified_base (358)..(358): a, c, t, g, unknown or other
  modified_base (411)..(411): a, c, t, g, unknown or other
tcagtgatacgtctcacgaccggtgctcgatttagtatctgatagttgggttggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaaactcttgctttatgatgtcagttatcggccctcaggagtttcngatcgcttctctggctccaagtctggcacncggcctcctgacccatctctgggctccaggctgaggcgaggctgattatttcngcagctaacaaaagagtacgccctcgtcggttggtttcgggacgggggacgaaggtcgaccgtactaagcacgaccagctcgcccgtcgtcactctcgtcccacctcctcacg

SEQ ID NO: 364324 - DNA, 578 bp, Homo sapiens
  misc_feature: GZ8MTXP02JXI11.9.38.D05.1.454.CMB.2.raw
  modified_base (359)..(359): a, c, t, g, unknown or other
  modified_base (432)..(432): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaactaccccggcaaacgcccccaaactcttgctttatgatgtcagttatcggcctcgaggtatttctgtatcgcttctcctgctcaagtctggcnccacggccctccctgaccatcctctcgggcctccgacggcgtggaggacggaggcgtgtattagtttctgcanacgggggtaacaaaagaagtacgacctcgtcggttcgggtttcgggacgggggaccgaacggtcgtaccgtaccgtagtaccgacgacccgaacgtccgtccgccccgtcggtcctaccgtccgtccgttcccgtccctccgtccg

SEQ ID NO: 364325 - DNA, 544 bp, Homo sapiens
  misc_feature: GZ8MTXP02F7GBP.9.38.D05.1.454.CMB.2.raw
  modified_base (302)..(302): a, c, t, g, unknown or other
  modified_base (329)..(329): a, c, t, g, unknown or other
  modified_base (361)..(361): a, c, t, g, unknown or other
tcagtgatacgtctcacgaccggtgctcgatttagtatctgatagttgggtttggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaaacaataccccggcaaacgcccccaaactcttgctttangatgtcagttatcgcctcaggatttcngatcgcttctctcggctccaagtctggccacncggccctccctgaccatctctgggctccaggctgaggacgaggctgatttattctgtcagactaacaaaaagacgtaacgcccttacgtcggttggttttcgggacgggggacaaacgggtgacccgtacgtaagtcacgaccgaagcctcgcccctggcactctcgtcccaccctcctcacg

SEQ ID NO: 364326 - DNA, 530 bp, Homo sapiens
  misc_feature: GZ8MTXP02GZDXC.9.38.D05.1.454.CMB.2.raw
  modified_base (339)..(339): a, c, t, g, unknown or other
  modified_base (343)..(343): a, c, t, g, unknown or other
  modified_base (362)..(362): a, c, t, g, unknown or other
  modified_base (426)..(426): a, c, t, g, unknown or other
  modified_base (497)..(497): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaaacgcccccaaaactcttgctttaatgatgtcagttatcggcctcaggtagtttctgatcgnttcncctggctccaagtctggcnccacggcctccctgacccatctctgggctccagctgagacgaggctgattagttctgcagctanaaaaagataagccctctcgttggtttcggcgggggaccaagggtcgtaccgtcaagtcaggcccaaggccncgcccctcgctactcgtctcccaccctctaccg

SEQ ID NO: 364327 - DNA, 518 bp, Homo sapiens
  misc_feature: GZ8MTXP02HK7WD.9.38.D05.1.454.CMB.2.raw
  modified_base (339)..(339): a, c, t, g, unknown or other
  modified_base (357)..(357): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaacgcccccaaactcttgctttatgatgtcagttatcggcctcaggagtttctgatcgcttcncctggctcaagtctggcnccacggcctccctgacccatcctctgggctcccaggctgaggcgaggctgattatttctgcagctacaaaagagtagccctctcgtggtttcggcgggggaccaaggtcgacgtcagtcagccaaggctcgcccctggtcactctcgttcccacctcctac

SEQ ID NO: 364328 - DNA, 539 bp, Homo sapiens
  misc_feature: GZ8MTXP02IYXSK.9.38.D05.1.454.CMB.2.raw
  modified_base (301)..(301): a, c, t, g, unknown or other
  modified_base (321)..(321): a, c, t, g, unknown or other
  modified_base (363)..(363): a, c, t, g, unknown or other
tcagtgatacgtctcacgaccggtgctcgatttagtatctgatagttgggtttggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaacgcccccaaactcttgctttangatgtcagttatcggccctnaggtatttctgatcgcttctctggctccaagtctggccaccncggcctccctgacccatctctgggcctccaggctggaggacgaggctgattattctgcagctacgaaaaagagtagccctgtcggtggtttcgggcgggggtaccaagggtcgaccgtcgtaaagtcaacgcccgaaggctacgccccctggccactctcgtcccgcctcctcacg

SEQ ID NO: 364329 - DNA, 546 bp, Homo sapiens
  misc_feature: GZ8MTXP02JOD0R.9.38.D05.1.454.CMB.2.raw
  modified_base (359)..(359): a, c, t, g, unknown or other
tcagtgatacgtctcacgaccggtgctcgatttagtatctgatagttgggtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaacgcccccaaactcttgctttatgatgtcagttatcggcctcaggagtttctgatcgtcttctctgctccaagtctggcacncggcctcctgaccatctctgggctccgagctgaggacgagctgattattctgcagctacaaaagagtagacctctcgtggtttcgggcgggggtacagggtcgaccgtcgtaacgtcgacgtacccgaacggcgtaccgcccccgtcggtcctaccgtcgtccgttccccgccctccgtactaccgg

SEQ ID NO: 364330 - DNA, 561 bp, Homo sapiens
  misc_feature: GZ8MTXP02HO6WA.9.38.D05.1.454.CMB.2.raw
  modified_base (307)..(307): a, c, t, g, unknown or other
  modified_base (328)..(328): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaaacaataccccggacaaacgcccccaaatcttgctttangatgtacagttatcggccctnaggtatttctgatcgcttcctctgctccaagtctggcaccacggcctccctgaccatctctggctccaggctgagacgagctgattattctgcagctaacaaaaagagtacgccctgttcggttgggtttccgggacgggggaccaaagggtcgacccggttactaaacgtcgaacgccccgaaaggcctaccgcccccgttggtacctacgtctccgttcccctaccctccc

SEQ ID NO: 364331 - DNA, 625 bp, Homo sapiens
  misc_feature: GZ8MTXP02JP1S4.9.38.D05.1.454.CMB.2.raw
  modified_base (304)..(304): a, c, t, g, unknown or other
  modified_base (429)..(429): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtattaactatgtctcctggtaccaacaactaccccggcaaacgcccccaaatcttgctttangatgtcagttatccggcctcgaggtatttctgtatcgtcttctctcggctcaagtctggcaccgcggcctcctcgaccatctctcgggcctccgaggctaggacggtacgagctgtatttattcngtacagtctacatagtcgactaagacgttcgggacaccgtaccgttccccggttagggttaaccgtttccgggggaccggggtaacggggtaaccccgtaaagggggttccgtaccccggttacccggtaacgggttcccgaaccggtaccccgtaacggtcccgtcccggtaccccccgttcggtacctaccccg

SEQ ID NO: 364332 - DNA, 629 bp, Homo sapiens
  misc_feature: GZ8MTXP02G8JRK.9.38.D05.1.454.CMB.2.raw
tcagtgatacgtctcacgaccggtgctcgatttagtatctgatagttgggtttggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaactaccccggcaaacgcccccaaactcttgctttatgatgtcagttatcggcctcgaggtagtttctgactcgtcttctctcggtcctacctaagtctcggccacccgaccgggtccctcccgtcgaccctatctccgtcggggccttccgaggcctggacggacgaggtcctggtatttatttctgcagactaacgaaaaagagtacgccctacgttcggttcgggtttcggggacgggggtaaccgtaaagggtcgacccggttaccgtaacggttccgaacggcccgaaacggtccgtccggtcccccgtacggtccaccgttccgttccgttcccccggtcccttcccgtacgtaacgg

SEQ ID NO: 364333 - DNA, 547 bp, Homo sapiens
  misc_feature: GZ8MTXP02FUSYI.9.38.D05.1.454.CMB.2.raw
  modified_base (323)..(323): a, c, t, g, unknown or other
  modified_base (440)..(440): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaaacgcccccaaaactcttgctttatgatgtcagttatcggcccctnaggagtttctgatcgctttctcctggctcaagtctggcaccacgcctccctgaccatctctggctccaggctgagacgagctgattattctagcagctaacaaaaagagtagccctntcggttggtttcgggcgggggaaccaagggtcgaaccgtcctaaagtcaacgcccaaaggcctacggccccctggtacctacttcctcgtttccccgcccctctacg

SEQ ID NO: 364334 - DNA, 645 bp, Homo sapiens
  misc_feature: GZ8MTXP02JVS9B.9.38.D05.1.454.CMB.2.raw
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaaactaccccggacaaacgacccccaaactcttgctttatgatgtctagttatccggccctcgaggtagtttctgtatcgtcttcctcgtgtctccaagtctcggccaccacggccctccctgaccatctcgtgggcctccgaggctggacggacgaggctagtatttactttcgtgactagtactaaacgaaaaacgaagtaacgtcccttacgttccggtttcggggttttaccggggaccggggggtaacctaacggggttacggtacccggttaccgtaaacggtaccgacggaccccgaaacggtcccttaccggcccccgttcgggtacccacccgttccgttccgtttacccccgacccgtttccccg

SEQ ID NO: 364335 - DNA, 650 bp, Homo sapiens
  misc_feature: GZ8MTXP02HFBL8.9.38.D05.1.454.CMB.2.raw
  modified_base (249)..(249): a, c, t, g, unknown or other
  modified_base (276)..(276): a, c, t, g, unknown or other
  modified_base (334)..(334): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactntgtctctggtaccaacaataccccggnaaacgcccccaaactcttgctttatgatgtcagttactcggccctcgaggtatttcgngtactcgtcttctctcggctccaagtctggcaccgcggccctccctgaccacttctcgtcgggcctccgacggtctggaggacgacgggtcttaggtaatttacgtttctcgacgtaacgtacctaacgaaaaaaagtacgtaacggtccccttacgttccgggtttacggggttttcgggggaccgggggtaaccgtaaggggtcgtacccggttacgtaaacggtcgaaccggtacccgaaaggtcccgtcccgcccccgttacggtcctaccgttccgtccggttcccccgcccttacccgtcgtaaacccgg

SEQ ID NO: 364336 - DNA, 650 bp, Homo sapiens
  misc_feature: GZ8MTXP02FP7AH.9.38.D05.1.454.CMB.2.raw
  modified_base (302)..(302): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctctgtaccaacaactacccgacaaacgccccaaactctgctttangatgtctagttatccggtccctctaggtagtttctgtatcgtcttcctctggctccaagtcctgccaccgaccggtccctcccgtacgaccacttcctcgtggcctccgaggcgtggacggacggacggtcgttagtactttagtttcgtgacaggtactaaacgaaaaagtacgtaacgcccgttcgttcgggtttcggggtttccggggacgggggtaaccgtaagggtaccggtaccgttaccgtaacggtaccgaacggtacccgtaaacggtcccgttacccggtcccccgttcgggtaccctacccgttaccgttcccggtaccccctacccctttaacccg

SEQ ID NO: 364337 - DNA, 544 bp, Homo sapiens
  misc_feature: GZ8MTXP02IB99Z.9.38.D05.1.454.CMB.2.raw
  modified_base (444)..(444): a, c, t, g, unknown or other
  modified_base (449)..(449): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaactaccccgacaaacgcccccaaactctgctttatgtatgtcagttactccggcctcgaggtagtttctgatcgcttcctctgctcaagtctggcaccacggccctccctgaccatctctggctcgagctgaggacgaggctagtattatactgctgtctctatatgacagtntggtnactcgtcccggttaggtacgttcgggacggacgggaccgtaacggtcgtaaccgtcgtaacggcaacgcccgaaggccgtccgtcccccgtccgg

SEQ ID NO: 364338 - DNA, 804 bp, Homo sapiens
  misc_feature: GZ8MTXP02JR9D7.9.38.D05.1.454.CMB.2.raw
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtaattaactatcgtctctgtaccaacaactaccccggacaaaccgccccaaactctgtactttatgtatgtctagttacgtccgtcctgaggtacgtttcgtgacttcgtccttcgtcgtccggtcctaccgtaacgtcgtcggacccacccgtacccggtcccttcccgtaccgtaccctacttcccgtcggtcggggtcccttccggaaggtcgtacgggacgggaacggtacggtccttaggtaacttttacgtttacgtacggaacgtaacggtaaccttaaaacggaaaaacggttaccgttaacccgggtaccccgtttcgggtttacccggggtttaccgggggttttacccggggggaaccggggggttaaacctaaacgggggttacccggtaaaccccggttaccggttaaaaccgggtacccggaaacccggttacccccggaaacgggttccccggtacccccggtccccccggtttaaccggtaacccgttaccccggtttaccctccccggtttaacccccgtcccctttacccggtacgtaaacccgg

SEQ ID NO: 364339 - DNA, 699 bp, Homo sapiens
  misc_feature: GZ8MTXP02IM57P.9.38.D05.1.454.CMB.2.raw
  modified_base (299)..(299): a, c, t, g, unknown or other
  modified_base (443)..(443): a, c, t, g, unknown or other
  modified_base (449)..(449): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtattaactatgtctctggtaccaacaactacccgacaaacgaccccaactctgactttangtatgtactagttactccgtcctcaggtagtttctagtactcgtcttctccgtcgtcctacgaacgtcgtcggccacccgtacggccctccctcgaccctatcctcgtcggtcctccgaggctggacgagaggtctaggtattnttacgngtcacggtactaaagaaaaacgtacgtaaccgtcccgttacggttaccgggtttcggggtttaccggggacgggggtaaaccgtaacggggttaccgtacccggttaccgttaaaccggtaccgaaacccgggtaccccgtaaacggggtccccgttaccccggtaccccccgtttccggggtaccccttaaccccggttcccggttccccggtttaccccccctacccccggttttacccaaaccccgg

SEQ ID NO: 364340 - DNA, 620 bp, Homo sapiens
  misc_feature: GZ8MTXP02ICUM8.9.38.D05.1.454.CMB.2.raw
  modified_base (392)..(392): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtattaactatgtctcctggtaccaacaactaccccggacaaacgcccccaaactcttgtctttatgatgtcagttatccggccctgaggtagtttctgatcgtcttctctcgcctccagtcgtggccaccgccggtccctccctcgacccncttcctctcgggcctccgaggccgtggacggacgaggctgtagtttattctgacacgactaaacgaaaagacgtacgccctcgtacggtttcggggtttcggggacgggggtaccgaaggtcggacccgttaccgtaacggtcctaacggacccgaaacgggtcctccgtcccccgtacggtcctaccgtccgttccgttcccccgtcccttccgttaccgtaaccgg

SEQ ID NO: 364341 - DNA, 639 bp, Homo sapiens
  misc_feature: GZ8MTXP02HQGOF.9.38.D05.1.454.CMB.2.raw
  modified_base (299)..(299): a, c, t, g, unknown or other
  modified_base (362)..(362): a, c, t, g, unknown or other
  modified_base (432)..(432): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctctgcactggaaccagcagtgacattggtattaactatgtctcctggtacaacaactacccggcaaacgcccccaaactcttgactttangatgtcagttatccggccctcaggtacgtttctgatcgcttctcgtggctcaagtcgtcggcnccaccggtcctcccgtcgacctactctcgtcgggcctccgagcgtaggaggacgagtctgtattatttcngtacagtacttaaacgaaaaagtacgtaccgtacccgttcgttcgggttacggggtttccggggaccgggggtaaccgtaagggtcggtaacccggttaccgttaaacggtccgtaaccggacccgaaacgggtcccgtacccggtccccccgttcggtaccctacccggtttcctcccggtttacccctacccccttccgtacccg

SEQ ID NO: 364342 - DNA, 594 bp, Homo sapiens
  misc_feature: GZ8MTXP02FY09C.9.38.D05.1.454.CMB.2.raw
  modified_base (307)..(307): a, c, t, g, unknown or other
  modified_base (337)..(337): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaactaccccggcaaacgcccccaaactcttgctttangatgtcagttatcggcctcgaggagtttcngatcgtcttcctctgctcagtctggcaccacggcctccctgaccatctcgtcggctccgagctgagcgagctgattattctgcagtactaaacgaaaaagtaagtaccgcccttcgttaccggtttcggggtttaccggggacgggggtaaccgtaaggggtacgtacccggttaccgtaaacgtccgtaacgaccccgaacggcctcccgcccccgtcggtacctaccgttccgttccgtcccccgtcccttcccg

SEQ ID NO: 364343 - DNA, 600 bp, Homo sapiens
  misc_feature: GZ8MTXP02JCSQE.9.38.D05.1.454.CMB.2.raw
  modified_base (367)..(367): a, c, t, g, unknown or other
  modified_base (441)..(441): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatcctcctgcactggaaccagcagtgacattggtattaactatgtctctgtaccaacactaccccggacaaacgcccccaaactctgtactttatgatgtctagttatcggccctgaggtatttctgactcgcttctctcggctcgaatcgtggccacncggtccctccctacgaccatcctcgtcgggcctcccgaggccgtggacggacgagtccgtagtactttattcgngtacagtactaaacgaaaaagtacgtaccgtcccttacggtcggttacggggttcggggacggggtaacgtaggtaccgacgtacgtacgacgaccgaacgcgtccgtcccgtcccgtcgtaacctcgtcgtacccgtaccctacctccgacgtaaccg

SEQ ID NO: 364344 - DNA, 638 bp, Homo sapiens
  misc_feature: GZ8MTXP02I1X1G.9.38.D05.1.454.CMB.2.raw
  modified_base (336)..(336): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtaattaactatgtctcctggtaccaacaactaccccggcaaacgcccccaaactcttgtctttatgatgtcagttatccggcctcaggtagtttcngatcgtcttctctcggctccaagtctggaccaccgcggtccctccctgaccctatctcgtcgggcctccgaggctggaggcgaggcctgtatttatttctgcgtagtactaacgaaaaagacgtaacggtcccctcgttcggtttcggggtttacggggaccggggggtacctaaggggtcgtaaccccggttacgtaaacggttccgaaccggacccgtaaacgggcccgttacccggcccccgttcgggtccctaccgttcccgtacccggttccccgtaccccgttcctacgtaaccgg

SEQ ID NO: 364345 - DNA, 532 bp, Homo sapiens
  misc_feature: GZ8MTXP02FMZM4.9.38.D05.1.454.CMB.2.raw
  modified_base (327)..(327): a, c, t, g, unknown or other
  modified_base (360)..(360): a, c, t, g, unknown or other
  modified_base (438)..(438): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtacccaacaataccccggcaaaagccccccaaaactcttgctttatgatgtcagttatcggccctcaggngttctgatcgcttctcctggctcaagtctggcnccacggcctcctgaccatctctgggctccagctgaggacgagctgattattctgcagctacaaaaagaagtagccctntcgtggtttcggcgggggaccaaggtcgaccgtcgtaagtcacgcccaaggcctcgccccctcggtcactcctcgtttccccgccctcctaccg

SEQ ID NO: 364346 - DNA, 584 bp, Homo sapiens
  misc_feature: GZ8MTXP02ISSWN.9.38.D05.1.454.CMB.2.raw
  modified_base (221)..(221): a, c, t, g, unknown or other
  modified_base (227)..(227): a, c, t, g, unknown or other
  modified_base (292)..(292): a, c, t, g, unknown or other
  modified_base (323)..(323): a, c, t, g, unknown or other
  modified_base (329)..(329): a, c, t, g, unknown or other
  modified_base (549)..(549): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctcgtgtctgggtctctggacagtcgatcaccatctctgcactggaacngcagtnactattgtattaactatgtctctagtaccaacaactacccgacaaacgccccaaatctgctttangatgtctagttactcgtcctagaggtattcngatcgnttctctcgctacagtctcggccaccgacgccctccctacgacctatccgtcgtcgggtctccgagctaggaggacgaggtctagtattagttctgcagactaaagaaaagacgttaccgaccgtcgttcggttcgggtttacggggaccgggggtaacagggtacgtacggtactaaacggtcaaccggaccgacggtcctccggccccgttcggtaccnccgtttacctccgttacccctaccgttactaaccg

SEQ ID NO: 364347 - DNA, 659 bp, Homo sapiens
  misc_feature: GZ8MTXP02H2REP.9.38.D05.1.454.CMB.2.raw
  modified_base (299)..(299): a, c, t, g, unknown or other
  modified_base (313)..(313): a, c, t, g, unknown or other
  modified_base (370)..(370): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccatctctgcactggaaccagcagtgactattggtaattaactatgtctcctgtaccaacaactaccccggacaaacgccccaaactctgctttancgatgtcagttacnccggccctgaggtgtttctgtatccgtcttctccgtcggcctactaagtctcggccnccgaccggtccctcccgtcgaccctactcctcgtcggggcctccgacggtcgtacggacggggacggtagggccttaggtaacttttacgtttcgtcgtaccgtaaacggtaccttaaaacgaaaaaacggtacgtaaccgtccccttacggtacggtttcggggtttacgggggaccgggggtaacgaacgggtccgtaacccgttacgtaacgtccgaccggtaccgaacggtcctcccgccccgtcggtcccaccgtccgtccgtcccccgtaccttcccgtaccg

SEQ ID NO: 364348 - DNA, 624 bp, Homo sapiens
  misc_feature: GZ8MTXP02FOYB5.9.38.D05.1.454.CMB.2.raw
  modified_base (301)..(301): a, c, t, g, unknown or other
  modified_base (376)..(376): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctctggtaccaacaataccccggcaaacgcccccaaactcttgctttangatgtcagttatcggccctcaggtagtttctgatcgctttctctggcctccaagtctggccaccgcggcctcccngacccatctcgtgggcctcgaggctggacggacgaggctgtaatttatttctgcagtactaacgaaaaagacgtacgaccccttcgttaccggttggggttttcggggaccgggggtacctaaggggtcgacccggttaccgtaaaacggtccaacggaccccgaaacgggtcccgttccggccccccgttcgggtcctaaccgttccgttcccggtttacccccaccccgttcctaccgtaaaccgg

SEQ ID NO: 364349 - DNA, 646 bp, Homo sapiens
  misc_feature: GZ8MTXP02G61M3.9.38.D05.1.454.CMB.2.raw
  modified_base (273)..(273): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctaccctgactcaacctgcctccgtgtctgggtctcctggacagtcgatcaccatctctgcactggaaccagcagtgacattggtattaactatgtctctggtacaacaactacccgnaaacgccccaaactcttgctttatgatgtctagttatccggccctcgaggtatttctgatcgtcttctctggccctccaagtctggccaccacggccctaccctgaccctatcctcgtcgggcctcccgagcctggacggacgaggctgtatttagttctagcagtacctaagaaaaagacgtacgtcccttagttacggttcgggtttaccggggacgggggtaacctaaaggggtcgtaaacccggttaccgtaaaacggttccgaacggacccgtaaacgggtccgtccggtccccccggttcggtaccaacccggtttccgttacccggtttcccccgtacccccttccgtaccgtaacgttaacccgg

SEQ ID NO: 364350 - DNA, 677 bp, Homo sapiens
  misc_feature: GZ8MTXP02GKZ9P.9.38.D05.1.454.CMB.2.raw
  modified_base (208)..(208): a, c, t, g, unknown or other
  modified_base (226)..(226): a, c, t, g, unknown or other
  modified_base (249)..(249): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccntctcctgcactggaaccngcagtgactattggtattaactntgtctctgtaccaacaactacccggacaacgccccaaactctgtcttatgatgtctagttactccggcctcgaggtagtttctgtacttcgtcttccgtcgtcggtcctaccgtagttctcgggacccacccgtccggtcccttcccgtcgaccctactccgtcgtcggggtcctccgaggcgtaggacgggacgaggcttaggtactttattcgtgactagactaaagtaaaagtagtaccgtaccccgttccggtttacggggttaccgggggttaccgggggaaccggggtacgttaaccgggtaccgtacccggtaacgttaccggaccgaccgtaccggacggtcccgtacccccggtcccggttaccgtccgttacccgttcccgttcccccgtacccctcccgttaccgtaccggtaaccg

SEQ ID NO: 364351 - DNA, 723 bp, Homo sapiens
  misc_feature: GZ8MTXP02G9LDF.9.38.D05.1.454.CMB.2.raw
  modified_base (231)..(231): a, c, t, g, unknown or other
  modified_base (320)..(320): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccngcagtgactattggtaattaactatgtctctacggtaaccaacaacgtaccccggacaaaccgacccccaaactcgttgtaccttttangtaattcgtactaaggtttacgtccggtcccctacgtagggttacgttttctagtaacgtccgtcctttcccgtccgtcggtacctaccgtaacggttccgtacgggtacccacccgtaaccggtcccccgtccctacggtacctacttccctcggtcgggcccttacgacgggtctagggacgggtaacgcgggttaccgtagtaacgtttacgtttcgacgactaggtaacccttaaaggaaaaaacgggtttcgaaccgttcccgttacgggtttcgggttcgggtttaccgggggaccgggggtaacacgggggttacgaccgttacgtaacggtccacgaccggtacgtccgtaccgtccccgtggtacctaccgtcgtcccgtccccgtccttaccg

SEQ ID NO: 364352 - DNA, 925 bp, Homo sapiens
  misc_feature: GZ8MTXP02J2GIY.9.38.D05.1.454.CMB.2.raw
  modified_base (255)..(255): a, c, t, g, unknown or other
  modified_base (310)..(310): a, c, t, g, unknown or other
tcagtgatacgtctcacgaccggtgctcgatttagtatctgatagttggggtttgggggggtctcaggaggcagcgctctcgggacgtctccaccatggcctgggctctgctattcctcaccctcctcactcagggcacagggtcctggacccagtctgccctgactcaacctgcctccgtgtctgggtctccgtggacagtcgatccaccatctcctgcactggaaccagcagtgactattaggtaattaactntgtcctctaggtaccaacaactaccccggacaaacgcccccaatcttgtctttangtatgtactagttactccggtacccctagtacggtagtttcgtacggtactccgtcttcgttaccgttccggtccttacccgtaaaggtttccgtcggaccccgttaaccccgacccggggtcccccttacccccgttacgaaccccgtattccccgtacgggtccgggggtcccttacccggaaacgggtttcccgtaagggggaaacggggttaaacccggggtacgggttaccgtttaaacggtttaaacgtttttaccggttacccgtaacgggtaacccgttaaaccgggtaaaaccgttaaaaaccgggtaaaaaaccggggttaacccggtttacccccgggtttacccccgggtttacccgggggttttaaccggggggttttaacccggggggtaacccggggggtaaacccggggttaaaccgggttaacccgggttaaccccgggttaaacccgttaacccgggtaaacccggtacccgggaaaccccgggtaaacccggtacccggttacccccggtacccccggttaccccgtacccgttaacccgttaccccgttacccgtttcccccgtaaccccgttcccgtacccggtaacgtaaccg

SEQ ID NO: 364353 - DNA, 692 bp, Homo sapiens
  misc_feature: GZ8MTXP02GUDMC.9.38.D05.1.454.CMB.2.raw
  modified_base (250)..(250): a, c, t, g, unknown or other
  modified_base (305)..(305): a, c, t, g, unknown or other
  modified_base (326)..(326): a, c, t, g, unknown or other
  modified_base (371)..(371): a, c, t, g, unknown or other
tcagtgatacgtctcacgaccggtgctcgatttagtatctgatagttggggtttgggggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccatctcctgcactggaaccagcagtgactattggtattaactntgtctcctggtaccaacaactaccccggcaaacgcccccaaactcttgctttaangatgtcagttactcggccctnaggtatttctgatcgtcttctctcggctaccaagtctggccaccnccggtccctcctcgaccctatccgtcgtcgggcctccgaggtcgtaggacggtacggaggtcctggtaactttagtttcgagctaaggacttaaacgaaaaaacgggtacttaccggtccccttacgttccggggtttacgggggttttccgggggacggggggtaaccgtaacggggtacggtaacccggttaaccgtaaaacgggtccgaaaccgaccccggtaaacgggtccctacccggggtccccccttcggggtaaccctaacccgttcccgttcccggtttacccccaaccctttccccgtacggtaaacccgg

SEQ ID NO: 364354 - DNA, 673 bp, Homo sapiens
  misc_feature: GZ8MTXP02I4ED4.9.38.D05.1.454.CMB.2.raw
  modified_base (369)..(369): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccatctcctgcactggaaccagcagtgactattggtaattaactatgtctcctggtaccaacaactaccccggacaaacgcccccaaactctgtctttatgatgtctagttatcggccctcgaggtatttctgactcgtcttctccgtcggctccaagtctggccnccgcggccctcccgtgaccatctcgtcgggtcctccgaggcgtggaggtacgaggtctaggtattagttctgactagtactaacgaaaaacgtcgtaaccgtccccgttcggttaccggttcgggggttttacgggggaccggggggtaacctaacgggggttccgtaaacccggttacccgttaaacgggtcccgaaaccgggtacccgtaaaccggggtccctcccggggtaacccccctcggggttacccgtaacccttcccgttccgtttaccccccgtaaccctttcccgttaacccgg

SEQ ID NO: 364355 - DNA, 543 bp, Homo sapiens
  misc_feature: GZ8MTXP02F0TDP.9.38.D05.1.454.CMB.2.raw
  modified_base (328)..(328): a, c, t, g, unknown or other
  modified_base (357)..(357): a, c, t, g, unknown or other
  modified_base (414)..(414): a, c, t, g, unknown or other
tcagtgatacgtctcacgaccggtgctcgatttagtatctgatagttgggtttggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtacaacaataccccggcaaacgccccaaactcttgctttatgatgtcagttatcggcctcaggagtttcngatcgcttctctggctcaagtctggcacncggcctccctgaccatctcgtgggcctccgaggctgaggacgaggctgatttattcngtcagactacaaaaagagttaacgccctcgttcgtgggtttcggcgggggaccaagggtcgaccgtacctaaagtcgacgaccaaggcctcgccccctggaacacctctcgtcccaccctcctacaacg

SEQ ID NO: 364356 - DNA, 608 bp, Homo sapiens
  misc_feature: GZ8MTXP02HHU9C.9.38.D05.1.454.CMB.2.raw
  modified_base (368)..(368): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggacaaaacgcccccaaaactcttgctttatgatgtcagttatcggccctcaggtagtttctgatcgcttctctcggcctcaagtctggcaccncggcctcctgaccatctctgggctccaggctgaggacgaggctagatttattctgccagtactacaaaaaagtacgtacggtaccctcgtcgggttcgggttttccggggacgggggtacaaacgggtcgaacccgtaccgtaaagtccgaaacggccccgaaacgggtccttaccgacccccctttcggggtccctaacttccgtttccggttacccccccgccccttaccgtacgacg

SEQ ID NO: 364357 - DNA, 598 bp, Homo sapiens
  misc_feature: GZ8MTXP02HKQKB.9.38.D05.1.454.CMB.2.raw
  modified_base (273)..(273): a, c, t, g, unknown or other
  modified_base (310)..(310): a, c, t, g, unknown or other
tcagtgatacgtctcacgaccggtgctcgatttagtatctgatagttgggtttgggggctggggtctcaggaggcagcgctctcgggacgtctccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctgtaccaacngcacccaggacaaacgtccccaaactcatgtatttangaggtacaataacgccggccctcgtcggggtccctgactccgtccttctcgtggcttaccaagttctgggaccaaacaccggccctccgtgacccgtctcgtggacctcgagctgacgagtgagtctagtattattactgcacgtctacatagtcgacgaacggccaaccactaaagtcgttaccgttacgggaaggtcggtaaacccgtacggtacccgtacccgttaccgtacggtaaccgaccggtaaccccgaacggtaccccaaaccccgtcttcggtaaccc

SEQ ID NO: 364358 - DNA, 567 bp, Homo sapiens
  misc_feature: GZ8MTXP02FH978.9.38.D05.1.454.CMB.2.raw
  modified_base (304)..(304): a, c, t, g, unknown or other
  modified_base (368)..(368): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaaccaacaactaccccggcaaacgcccccaaactcttgctttangatgtcagttatcggccctcaggtagttctgtatcgcttctctcggctccaagtctggccaccncggccctcctgaccatctctgggcctcgaggctgaggacgagctgatttattctgcagactaacgaaaaagagtacggccctcgttcggttacgggtttcggggacgggggtacaacgggtcgacccgtacgtaacgtcgacgacccgaacggcctccgcccccgtcggtccactccgtccgtccccgcctcctcaacg

SEQ ID NO: 364359 - DNA, 702 bp, Homo sapiens
  misc_feature: GZ8MTXP02HESRQ.9.38.D05.1.454.CMB.2.raw
  modified_base (304)..(304): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtattaactatgtctctgtaccaacaactacccggacaaacgccccaaactctgctttangatgtctatactcggcctcgaggtagtttctagtactcggtcttccctcgtcggtcctaccgtaagttccgtacggcccaacccgtaccgggtccccttaccccgtacgtaaccctacttcccgtcgttaccggggtcccttacccggacgggttccgtacggggacgggaccgggtaacggtcccgttaggttaactttacgttttacgcgtacgtacggtactaaacgaaaaacggtaacgtaccgtcccgttacggttcgggtttcggggtttaccgggaccgggggtacgtaacgggtacgtaccggtaccgtaacgtaccgacggtacccgaacggtcctacccggtccccgtacggtacctaccgttccgtccgtacccctacccttacccg

SEQ ID NO: 364360 - DNA, 531 bp, Homo sapiens
  misc_feature: GZ8MTXP02F2SCX.9.38.D05.1.454.CMB.2.raw
  modified_base (331)..(331): a, c, t, g, unknown or other
  modified_base (337)..(337): a, c, t, g, unknown or other
  modified_base (363)..(363): a, c, t, g, unknown or other
tcagtgatacgtctcacgaccggtgctcgatttagtatctgatagttgggtttgggggttctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaaactcttagctttatgatgtcagttatcggcctcaggagtttcngatcgnttctctggctccaagtctggccaccncggcctccctgaccatctctgggctccaggctgaggacgagctgattattctgcagctacaaaaagagtagccctcgtcgtggttttcgggcgggggtaccaagggtcgaccgtctaagtcacgcccaaggctcgcccctcggtcactctcgtcccgcctcctcaacg

SEQ ID NO: 364361 - DNA, 610 bp, Homo sapiens
  misc_feature: GZ8MTXP02G7ZJ9.9.38.D05.1.454.CMB.2.raw
  modified_base (307)..(307): a, c, t, g, unknown or other
  modified_base (338)..(338): a, c, t, g, unknown or other
  modified_base (348)..(348): a, c, t, g, unknown or other
  modified_base (386)..(386): a, c, t, g, unknown or other
  modified_base (404)..(404): a, c, t, g, unknown or other
  modified_base (419)..(419): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtaattaactatgtctcctaggtaaccaacaactaccccggacaaacgccccctaaactctgactttangatgtacagttatccggcctcaggtatttcngatcgcttcnctgctcagtctcgcaccgcgcctcctgacctatctcgnggctccgagctgagacgngctagtagttacttncgtacacgtaccttaaaacgaaaagtacgttacgaccccgttgtcgggtttccggggtttacggggaccgggggttaaccgtaagggttaccgtaacccggttacccgtaaaggtccaaccggacccgtaacggcctcccggaccccgttcggtaccaccttcgtcccgttaccccctacccgtacctacg

SEQ ID NO: 364362 - DNA, 558 bp, Homo sapiens
  misc_feature: GZ8MTXP02JEFPQ.9.38.D05.1.454.CMB.2.raw
  modified_base (299)..(299): a, c, t, g, unknown or other
  modified_base (361)..(361): a, c, t, g, unknown or other
  modified_base (419)..(419): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctctgcactggaaccagcagtgactattggtattaactatgtctctggtaccaacataccccggcaaacgccccaaactcttgctttangatgtcagttatcggcctgaggagtttctgatcgcttctctcggtctccaagtctggccacnccggcctccctgaccatctctgggcctcgaggctggaggagagctgtatttatttcgngtacagtctactatagtcgtacgtacgtttcgttaccttcgttacgaagtagttacggttacgggacgggtacggacgacggtcgtacggtaccgtcgtgacgtcgacgaccgacggccgtcccgtaccccgtcgtacc

SEQ ID NO: 364363 - DNA, 655 bp, Homo sapiens
  misc_feature: GZ8MTXP02IV139.9.38.D05.1.454.CMB.2.raw
  modified_base (302)..(302): a, c, t, g, unknown or other
  modified_base (336)..(336): a, c, t, g, unknown or other
  modified_base (369)..(369): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcacatctcctgcactggaaccagcagtgactattggtaattaactatgtctctggtaccaacaactacccggacaaacgcccccaaatcttagcctttangattgtacagttactcggcctcgaggtactttcngactcgacttctccgtggcctcaagtctggccnccgacgcctccctgacccatctctcgggctcccgagctggagacgaggtctagattagttcgtgactagaccttaaagaaaaacgtacgttaaccgccccgttagttacgggttggggttttacccgggggacgggggtaaaccctaaaggggttccggtaacccggttacgttaaaacggttccgaaacggaccccgtaaacgggtcccgttaacccggtacccccgttcgggtaccctaaccgtttcccgtaccggtttcccccggcccctttaccgtaacccg

SEQ ID NO: 364364 - DNA, 692 bp, Homo sapiens
  misc_feature: GZ8MTXP02G2XE0.9.38.D05.1.454.CMB.2.raw
  modified_base (289)..(289): a, c, t, g, unknown or other
  modified_base (313)..(313): a, c, t, g, unknown or other
  modified_base (318)..(318): a, c, t, g, unknown or other
  modified_base (339)..(339): a, c, t, g, unknown or other
  modified_base (377)..(377): a, c, t, g, unknown or other
  modified_base (401)..(401): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcaagtgactagttaggtattaactatgtctctagtaaccaactaacgtaccccgganaaaccgccccaaatctgtctttangtatntctagttatccgcctgtagtnttctagtactcgtcttctcgtcgtctaccgtagtccgngccgaaccgcggtccctaccccgngtaccctcgtccgtcgtcggtcctccggaggtaccgcgggaacggtaccggacggtcgttacgttaaatttccgttgtacgacggtacttaaacgaaacgtaaaaagggtaccgtaaccgtcccggttacgttcggggttacgggtttaccgggggacccgggggtaacgtacggggtaccgtacccgggttacttaaacggtcccgaaccggttacccgaccggtccctcccggtcccccgttacgggtccctaccttcccgtcccggtttaccccccgtaccgtacccg

SEQ ID NO: 364365 - DNA, 610 bp, Homo sapiens
  misc_feature: GZ8MTXP02J2VEC.9.38.D05.1.454.CMB.2.raw
  modified_base (227)..(227): a, c, t, g, unknown or other
  modified_base (265)..(265): a, c, t, g, unknown or other
  modified_base (276)..(276): a, c, t, g, unknown or other
  modified_base (296)..(297): a, c, t, g, unknown or other
  modified_base (300)..(300): a, c, t, g, unknown or other
  modified_base (308)..(308): a, c, t, g, unknown or other
  modified_base (319)..(319): a, c, t, g, unknown or other
  modified_base (323)..(323): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccngcagtgacattggtattaactatgtctctggtaccaanaataccccggnaagccccaaatctgctttannatntcagtacncgcctgtagtnttcnatctctctctcgctacagtctcgaccacgtccgcctacctcgactcgtcgtcgtacggcctcgacgtcgtaggacggcgtaggtcgtacgtagttacttacgtacgacgacgtaacgtaaacgtaaacgtaacgtacgtaccgtacgttcgggttacgggttacggggtacggggtacggtacggtacgtaccgtaccgtaacgtacgtaccggaccgaccgtaccgtacccgtccccgtaccgtccgtaccgtaccgtcccgtcccgtcccgtacccgtacgtacg

SEQ ID NO: 364366 - DNA, 663 bp, Homo sapiens
  misc_feature: GZ8MTXP02HQ6RS.9.38.D05.1.454.CMB.2.raw
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtacccaacaaataccccggacaaacgcccccaaactcttgctttatgatgtcagttatcggccctctaggagtttctgatcgactttcctctggctccaagtctgccaccacggcctcccctgaccctatcctcgtcggcttccgaggtctgaggacgagtctgtattattctgctaggctaaacgaaaaagtaacgtaacgtccccgttacgtcggttcggggttttaccggggaccggggggtaaacctaacggggttaccggtaaccccggtttaccgtaaacggttacccgaaccggtaccccgaaacgggtcccgtacccggtccccccgttacggggtacccttaacccgtacccgtttcccggtttaaccccccttccccggtttaacccccg

SEQ ID NO: 364367 - DNA, 550 bp, Homo sapiens
  misc_feature: GZ8MTXP02JHBH2.9.38.D05.1.454.CMB.2.raw
  modified_base (247)..(247): a, c, t, g, unknown or other
  modified_base (353)..(353): a, c, t, g, unknown or other
  modified_base (413)..(413): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactntgtctcctggtaccaacaataccccggcaaagcccccaaactcttgctttatgatgtcagttatcggcctcaggagtttctgatcgcttctctgctcagtctggcnccacgccctcctgaccatctctgggctcccgaggctgaggaccgagggctgattatttcnggtccaggcttacaaaaagacgtaagcccttacgtcgttcgggttttcggcgggggaacctagggtcgtacccgtacgtagtaccgagcccgaaagccgtcgccccctggtacacttctcgtcccaccctcctaccg

SEQ ID NO: 364368 - DNA, 803 bp, Homo sapiens
  misc_feature: GZ8MTXP02GAHSF.9.38.D05.1.454.CMB.2.raw
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgactattggtaattaactatgtctcctggtaccaacaactaccccggacaaacgacccccaaatccttgctttatgatgtctagttatccggtccctgaggtagtttctgtatccgtcttctcgtcggtcctaccgtaagtccgtggaccctaacccgacccgggtccccttccccgtacgtacccctacgttcccgtccgtcgggggtcccttacccggtaacgggtccgttacggggaacgggtaaccggacggggtccgttaggtacgtttttaactttcgtacgtaccgttaacgaccgttaaaaccaaaaaagggtaaccgttaaccggtcccccgttacggtttacccggggtttacgggggtttttaccgggggacccgggggggttaaccctaaacgggggttacccggtaaccccggttaacccggttaaaacgtcccggttaaaccggacccccgtaaacgggcccgttaccccggtcccccccgttacggggtaaccccttccccgtttaccgttaccccggtttcccccctaccccgttacccgttacgtaaacccggg

SEQ ID NO: 364369 - DNA, 567 bp, Homo sapiens
  misc_feature: GZ8MTXP02JFKJP.9.38.D05.1.454.CMB.2.raw
  modified_base (249)..(249): a, c, t, g, unknown or other
  modified_base (277)..(277): a, c, t, g, unknown or other
  modified_base (302)..(302): a, c, t, g, unknown or other
  modified_base (333)..(333): a, c, t, g, unknown or other
  modified_base (427)..(427): a, c, t, g, unknown or other
  modified_base (532)..(532): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactntgtctcctggtaccaacaataccccggnaaacgcccccaaactcttgctttangatgtcagttatcggcctcgaggtagtttcngatcgtcttctctcggctccaagtctggccaccgcggcctccctgaccctatcctcgtgggcctccgaggctgaggacgaggctgtattattcngtcagactaacaaaagagtagccctctcggttggtttcgggcgggggtacaagggtcgaccgtaccgtagtcgacgaccaaggcgtccgtcccccgtggtaaccncgttcctaccgtcccctaccctccctacgtaaccg

SEQ ID NO: 364370 - DNA, 599 bp, Homo sapiens
  misc_feature: GZ8MTXP02FJE06.9.38.D05.1.454.CMB.2.raw
  modified_base (340)..(340): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaacgcccccaaaactcttgctttatgatgtcagttatccggccctacaggagttttcngatcgcttcctctgctccaagtctggcaccacggccctcctgaccatctctggctccagctagaggacgaggctgattatttctgtacacgactaacaaaaagaaacgtacgtacccgtacgttcggttcggggttttccgggacggggggtaccgtaaacggggtacggtaccggtaccgtaaacgtacgtacgacccgaaacggcctaccggtcccccgtaccggtcctaccgtcctccgttccccacccttccccg

SEQ ID NO: 364371 - DNA, 543 bp, Homo sapiens
  misc_feature: GZ8MTXP02H0XM4.9.38.D05.1.454.CMB.2.raw
  modified_base (281)..(281): a, c, t, g, unknown or other
  modified_base (304)..(304): a, c, t, g, unknown or other
  modified_base (424)..(424): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggnaaagcccccaaatcttgctttangatgtcagttatcggccctcaggtagtttctgatcgtcttcctctggctccaagtctggcaccacggcctccctgaccatctctggctaccgaggctgaggacgaggctgattattctgnagctacaaaagatacgcctctgtcggtttcggcgggggtaccaaagggttcgaccgtaccgtaaggtcaacgtccaaacggctcgccccgtcggtcctacgtctcgttcccgaccttcc

SEQ ID NO: 364372 - DNA, 691 bp, Homo sapiens
  misc_feature: GZ8MTXP02IQ8TG.9.38.D05.1.454.CMB.2.raw
  modified_base (225)..(225): a, c, t, g, unknown or other
  modified_base (248)..(248): a, c, t, g, unknown or other
  modified_base (273)..(273): a, c, t, g, unknown or other
  modified_base (335)..(335): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccngcagtgactattggtattaactntgtctctgtacaacaatacccgganaacaccccaactctgtctttatgatgtactagttactccggtccctcgtacggtagttttcngtactccgtctttcttcccgtcggtacctcccgtaaagttccgtacgggaccctacccggaccggtccccttccccgtaccgtaaccctcttccgtcgttcgggctcccggacggcgtgggacgggacgacggtcgtagtactttattcgtagactacgactaaacgtaaaagtaacgtacccgtcccgtttcggttcgggtttacggggtttaccgggggacgggggtaaaccgtaggggtaccggtacccgttaccggtaaacgtccgaaacggaccccggttaacggcccgttcccggccccgttcggtaacctccggttacccttaccgttccccctacccggttcctaccg

SEQ ID NO: 364373 - DNA, 726 bp, Homo sapiens
  misc_feature: GZ8MTXP02JXR8Q.9.38.D05.1.454.CMB.2.raw
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatcctcctgcacgtcggaaccagcagtgactagttggtaattaactagtgtcctccgtacggtaaccaaacaaccgtaccccggacaaaccgacccccaaacttcttagtactttatgtatgtactagttcgtccggcccctgacggtatttctgactcgtcttcgtctccggtctaccgtagtccgtcggacccacccgaccggtccctacccgtactaacccgtcttccgtcgtccgggtcccgtacgacggtcgtacgggaccggaacggtgtaccgttagttacgttttacgttcgtacgtacgtaacgtaactaaaacggtaaaagtaacgttacccggttacccgttaccgggtttcggggtttaccgggggtttacgggggaccggggtaaacgtacgggtaccgtaccggtacgtaacggtccgaaccggacccgaacggtcccgtacccggtacccccgtggtaaccctccgttccggtcccctacccaccccgttacgactaaccgg

SEQ ID NO: 364374 - DNA, 634 bp, Homo sapiens
  misc_feature: GZ8MTXP02FQYEO.9.38.D05.1.454.CMB.2.raw
  modified_base (197)..(197): a, c, t, g, unknown or other
  modified_base (253)..(253): a, c, t, g, unknown or other
  modified_base (303)..(303): a, c, t, g, unknown or other
  modified_base (338)..(338): a, c, t, g, unknown or other
tcagtgatacgtctcacgaccggtgctcgatttagtatctgatagttgagtttgggggtctcaggaggcagcgctctcgggacgtctccaccatggcctgggctctgctattcctcaccctcctcactcagggcacgagggtcctggacccagtctgccctgactcaacctgcctcgtgtctgggtctccgtggacngtcgatccacatctcctgcacgtggaaccagctagtgactattaggtaattacgtntgtctcgtggtaccaacaactacccgacaacgccccaaatctcgctttangatgtactagttactcggcctcgaggtctttcgtnactcgcttacgtccgtacggctaccgagtctacggtccaccgaccgggcccttccgtccgaacctcgttactcggtcgggacctccgaaggtcgtacgaggaccgaggcttagtacttattctagcacgactaaacgaaaagtaaggtcctcccgttagttcggttaggggtttaccggggacggggtacctagggtaaccgtacgtcgtaaaacgtccgacggacccgtaaacggtcctcccgtaccccgtgggtccctaaccgttcttaccccgtaccctccccgtcttaaccg

SEQ ID NO: 364375 - DNA, 740 bp, Homo sapiens
  misc_feature: GZ8MTXP02I6NL9.9.38.D05.1.454.CMB.2.raw
tcagtgatacgtctcacgaccggtgctcgatttagtatctgatagttggggtttggggggggtctcaggaggcagcgctctcgggacgtctccaccatggcctgggctctgctattcctcaccctcctcactcagggcacagggtcctggacccagtctgccctgactcaacctgcctcgtgtctgggtctctggacagtcgatcaccatctctgcactggaaccagcagtgactagttaggtattaactatcgtctccgtagtaccaacaacgtaccccggacaaaccgaccccctaaacttcgttagtaccttttaatgtaattcggtactaaggtttacgtcccggtacccctagtacggttacgtttcgtagtactccgtctttccgtcgttccggtcctaccgtaacgttccgttacgggaccctacccgtaccgggtcccctaccctacgtaccctagttcccgtcggtaccggggtccctccggacggtaccgtagggaacggaccgaggtccgttaggttaatttctttcgagtaccgtacgtaaaccgtaaaacgtaaaaagtaccggtaactcccccgttaaggttcgggtttacggggtttcgggggaaccggggtaactaggggtaccgtaccgttacgtaaacgtcgaacggtacccgtaacgggtccctaccgtcccgttacgtaacctaccgttccgttcccgtacccctcccttacgacgtacg

SEQ ID NO: 364376 - DNA, 706 bp, Homo sapiens
  misc_feature: GZ8MTXP02I51N1.9.38.D05.1.454.CMB.2.raw
  modified_base (274)..(274): a, c, t, g, unknown or other
  modified_base (290)..(290): a, c, t, g, unknown or other
  modified_base (296)..(296): a, c, t, g, unknown or other
  modified_base (327)..(327): a, c, t, g, unknown or other
  modified_base (356)..(356): a, c, t, g, unknown or other
  modified_base (365)..(365): a, c, t, g, unknown or other
  modified_base (385)..(385): a, c, t, g, unknown or other
tcagtgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtaattaactatgtctctagtacaacataccccgnaaacgccccaaatctnctttangatgtcagttactcggcctcgagtagtttcngattcgcttctctacggcttccaagttcncggccaccncgggtcctccctgaaccctntcctcgtcgggcctcgaggcgaggacggacgagtctagttatttacgttcgtacgtacgtaacgtaacgtaaaacgtaaaaacgtaaacgtaaccgtacccgttaccgttaccgggtttacggggtttaccgggggtaacgggggtaaccgggtaaacgggtacggtaacccggttaaccggttaaacggttaaccgtaacccggtaacccggtaaaccggtaccgttacccggtacccccggttacccggttaacccgttaacccgttacccgtttaccccgttacccccgttacccccgttacccgttaccgtaaaccg

SEQ ID NO: 364377 - DNA, 810 bp, Homo sapiens
  misc_feature: GZ8MTXP02F42IX.9.38.D05.1.454.CMB.2.raw
tcagtgatacgtctcacgaccggtgctcgatttagtatctgatagttgagtttgggggtctcaggaggcagcgctctcgggacgtctccaccatggcctgggctctgctattcctcacccctcctcactcagggcacagggtcctggacccagtctgccctgactcaacctgcctcgtgtcgtggtctcctggacagtcgatcaccatctcctgcactggaaccagcagtgactagttggttaattaactatgttccttccgtacggtaaccaaacaaacgtaaccccggacaaaaccgacccccctaaacttcttacgtcttttaatagtattcggtactaacggtttactcccggtacccctacgtaacgggttagtttactggtactcgtcctttcttaccgtcggtaccctacgtaaacggttccgtaccggtacccaccccgtaacccgggtcccccttccctacgaacccctagttccttacgggtcgggtcctacccggacgggacgtacgggaagggtacccggaagggtccgtttaacggttaactttaactttccgtacggtaacgtaacgtaaccgtaaaaccgtaaaaaacggtaacgtaccggtccccgtttacggttaccggggtttcgggggtttaccgggggaacgggggtaaacctaacgggggttaccgtaacccgttaccggtaaacgtaccggaaaccggtacccggaacggtccccgtaccggtacccccgtaaccggttccctaaccgttcccgttacccggttaccccctaacccgtccgtaaaccg

SEQ ID NO: 364378 - DNA, 693 bp, Homo sapiens
  misc_feature: GZ8MTXP02J4L7H.9.38.D05.1.454.CMB.2.raw
  modified_base (252)..(252): a, c, t, g, unknown or other
  modified_base (310)..(310): a, c, t, g, unknown or other
  modified_base (402)..(402): a, c, t, g, unknown or other
tcagtgatacgtctcacgaccggtgctcgatttagtatctgataggttggggtttggggggggtctcaggaggcagcgctctcgggacgtctccaccatggcctgggctctgctattcctcaccctcctcactcagggcacagggtcctggacccagtctgccctgactcaacctgcctcgtgtctgggtctcctggacagtcgatcaccatctcctgcactggaaccagcagtgactattggtattaactncgttctcctcgtaacaacgtacaaccgccgaacaccctaactacttatcgttatagtntgtctcgtacgtcgtccgtacgtacgtaggttacgttcgtcgtacttccgtcgttcgttacccgtcgtccgtccgaaaggtcctacgggtcncccaaccgggccctcccctagaccctctacgtcggtcgtcgggtaccgtccgacgggcggtaacggaggtaccggtggtaacttcgttaaagtttcctttacggactaccggaatacccgtaaagaaacgtacgtaacggtcgttacgttcggtacggggtcgtttacgggggtccgtaacggggttcgaacgggtcctaaacggtcccgaacggttaccctaacgggcccctacgggtaacccgtcccggtaccctccgttcccgcccgtttttaccaccccgtttaccg

SEQ ID NO: 364379 - DNA, 698 bp, Homo sapiens
  misc_feature: GZ8MTXP02FOYQP.9.38.D05.1.454.CMB.2.raw
  modified_base (228)..(228): a, c, t, g, unknown or other
  modified_base (309)..(309): a, c, t, g, unknown or other
  modified_base (385)..(385): a, c, t, g, unknown or other
tcagtgatacgtctcacgaccggtgctcgatttagtatctgatagttggggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctctgcactggaaccngcagtgactattggtattaactatgtctcctgtaaccaacaactaccccggacaaacgacccccaaactcttcgtctttangtatgtactagttactcccggtcctacgaggttacgtttctagtactcgtcttctctcggctcagtctcgccaccnccgtcctcctcgacctattcgcgtgggcctcggacgtgtacggacggaccggtaggccttagttaactttactttcgagtaccgtagtaaccgtaaaacgaaaagaaacggttcggttaacccttccgggttacggggttttcggggttaccgggggtaacgggggtaaccgtaaacggggttccgtaaccccggtaacttacgggtaccgaccggtaacccggaacgggttcccgtacccggcccccgttacggtcccttaacccgttaccgttaccccggttccccgtaacccttccgtaccgttaaacgg

SEQ ID NO: 364380 - DNA, 804 bp, Homo sapiens
  misc_feature: GZ8MTXP02JEWTZ.9.38.D05.1.454.CMB.2.raw
  modified_base (216)..(216): a, c, t, g, unknown or other
  modified_base (438)..(438): a, c, t, g, unknown or other
  modified_base (461)..(461): a, c, t, g, unknown or other
  modified_base (479)..(479): a, c, t, g, unknown or other
  modified_base (501)..(501): a, c, t, g, unknown or other
tcagtgatacgtctcacgaccggtgctcgatttagtatctgatagttgggtttgggggctggggtctcaggaggcagcgctctcgggacgtctccaccatggcctgggctctgctattcctcaccctcctcactcagggcacgagggtcctggacccagtctcgccctgactcaacctgcctccgtgtcgtggtctcctggacagtcgactcaccntcctcctgccacgtacggaacagacaggtcgatagtttaggttaattaactagtgtcctccgtacgtaacccaaactaccgtaacccccggaacaaaacccgacccccctaaaattccttagtaccttttatagtacttgtacgtacgttacgtcccggtccctacgtaggttacgtttcgtagtacttcgtcgttccctcgtacgtcctaccgtagtccgngtcccaccgtaccgtcccttccnccgtactcctcgtcccgnggggtacccttacgggacggtntacgggaaacgcggaacgtcgtttaagttatttaccgttacacgccgtaaacgtaacgtaaaaacgaaacggtacttacccggtccttcggttacgggggtttttccgggaaaccggggggaccggggttaaccaaacgggggtttaccccgtaggtttaaaccccggttaacggtaccgaacccccggggttaagggaacccccggtttcgtcccccccggggtaacccgtttaccccggggaaactttacccccgttccccggtttacccccgttacccccgtacccctttaaaccccggg

SEQ ID NO: 364381 - DNA, 773 bp, Homo sapiens
  misc_feature: GZ8MTXP02FWF34.9.38.D05.1.454.CMB.2.raw
  modified_base (289)..(289): a, c, t, g, unknown or other
  modified_base (309)..(309): a, c, t, g, unknown or other
  modified_base (322)..(322): a, c, t, g, unknown or other
  modified_base (340)..(340): a, c, t, g, unknown or other
tcagtgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatcctcctgccacgtggaaccagcagtgactattaggtaattaactagtgtctcctgtaaccaacactaccccgacaacncccctaatctgtactttagngatgtctagttcnccggcctgaggtatttcngtactcgtcgttctcgtacggcctaccgagtcctggaccctaccgccggtcccttcccgtagaccctcgtcctcggtacgggtcctaccggaggtccgtaggggacggtacggacgtcgttacgttaatttcgttcgacgacgtaaacgtaccgtaaaacgtaaaaaggtaccgttacccggtccccgtttacggggttaccggggtttaccgggggtttaaccgggggacccgggggttaaacccgtagggtttacccggggtaacccgttaaccggttaaaacggtcccggtaaaccgggacccgttaaaccggggttaccccgttccccggttaacccccggttacggttcccccgtttacccggttacccggtttaccccccggggtttcccccgtaccccctttaacccggacggtttaaaaccccgg

SEQ ID NO: 364382 - DNA, 566 bp, Homo sapiens
  misc_feature: GZ8MTXP01BNM6J.52.28.C06.1.454.CMB.2.raw
  modified_base (226)..(226): a, c, t, g, unknown or other
  modified_base (338)..(338): a, c, t, g, unknown or other
  modified_base (362)..(362): a, c, t, g, unknown or other
  modified_base (364)..(364): a, c, t, g, unknown or other
  modified_base (368)..(368): a, c, t, g, unknown or other
  modified_base (389)..(389): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggagatcctcttcttggtggcagcagccacaggagcccactccctggagcgtctggtacaatctggggactgaggtaaagagaccaggggcctnagtgaaggtctcctgtaaggcttctggataccccataaccggctactactacactgggtgcgacaggccccctggacaagggcttgagtggatgggggtgaacaatcccaanagtggagcaccggtcgcacagaanangcgnggtagtgaggcgaggcgacancgacgacgacgacgacgaccaacaacacacgaccacagtagacgacggtaagtagtactacgacatcgtacgaccgaccgtaccggtaccgtacttattaattgttggtaggaggacggacggaccgacgttacgtaaccgtacgaacgagtacggttacggtcggttcggggtcgg

SEQ ID NO: 364383 - DNA, 545 bp, Homo sapiens
  misc_feature: GZ8MTXP01B9X2I.52.28.C06.1.454.CMB.2.raw
  modified_base (501)..(501): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtgcgacaggcccctggacaaagggcttgagtggatgggggtggaacaatcccaacagtggaggcaccggtccgcacagaaatatgcgcgggaagtttcgagggcaggggtcacatgaccagcgacaggtccaactaacacacgcctacatggagcgtaaagtagacctagacatctgacgacacggcgtctattaatgttgtgagagcggacccgnttcgaacctcgaaccagtcggacggtcgttcgggggaacccggg

SEQ ID NO: 364384 - DNA, 535 bp, Homo sapiens
  misc_feature: GZ8MTXP01EP1O5.52.28.C06.1.454.CMB.2.raw
  modified_base (368)..(368): a, c, t, g, unknown or other
  modified_base (430)..(430): a, c, t, g, unknown or other
  modified_base (435)..(435): a, c, t, g, unknown or other
  modified_base (509)..(509): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttctggactaccccataaccggctactactacactgggtgcgacaggcccctggacaagggcttgagtggatgggggtgaacaatcccaacagtggaggcaccggtcgcacagaatatgcgnggaaagtttcgagggtcaggggtcacatgacagcgacaggtccaactaacacacgcctaacntaggngacgtaagtagactgacatctgacgacacgggctctattaatgttgtgagagacggacccattgaactcgaacntgggaccgtcgttcggggaacccggg

SEQ ID NO: 364385 - DNA, 535 bp, Homo sapiens
  misc_feature: GZ8MTXP01EZA3A.52.28.C06.1.454.CMB.2.raw
  modified_base (470)..(470): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactactacactgggtgcgacaggcccctggacaagggcttgagtggagtgggggtgaacaatcccaacagtggaggcacggtcgcacagaatatgcgcggaagtttcgagggcaggggtcaccatgacagcgacaggtccaactaacacagcctacatggagcgtaaagtagactagacatctgaacgcaacggcccgtntattaatgttgtgagagaggacccgattcggaacctcgaacgatggacgtcgttcggggaaccgg

SEQ ID NO: 364386 - DNA, 555 bp, Homo sapiens
  misc_feature: GZ8MTXP01EWXPN.52.28.C06.1.454.CMB.2.raw
  modified_base (225)..(225): a, c, t, g, unknown or other
  modified_base (284)..(284): a, c, t, g, unknown or other
  modified_base (467)..(467): a, c, t, g, unknown or other
  modified_base (501)..(501): a, c, t, g, unknown or other
  modified_base (511)..(511): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgagtaaagagaccaggggcctnagtgaaggtctctgtaaggcttctggactacccataaccggctactactacactgggtncgacaggcccctggacaagggcttgagtggagtgggggtaggaacactacccaacgagtggaggcaccggtccggcacagaatagtagcgcgggaagtttcgaggggcaggggtcaccatcgaccaggcgacgaggtccaactacacacgcctacatagacgacgtaaagtaggactagaacntctgacgacgacgccgtctataattgttgtgagngaggacccgngttcgaacctagaaccgagtgggacgttcgttggggaacccggg

SEQ ID NO: 364387 - DNA, 574 bp, Homo sapiens
  misc_feature: GZ8MTXP01EGKSX.52.28.C06.1.454.CMB.2.raw
  modified_base (251)..(251): a, c, t, g, unknown or other
  modified_base (446)..(446): a, c, t, g, unknown or other
  modified_base (498)..(498): a, c, t, g, unknown or other
  modified_base (532)..(532): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcnggactaccccataaccggctactactacactggtgcgacacggcccctggacaaaggggcttagagtggagtgggggtaggaaacaactcccaaacgagtggaaggccaccgggtccgacacaaggaatatggacgcgggtaaagtttcgaggggcaggggtacacaatgacccagcgacaggtccaactaacanagcctacagtgagacgtaagagactgaacatctagaacgcgacggcccgttntagttaatttggttgtgagaggaacgaccccggnttacgcccagaacctagtgggacggtcgttaagggggcccgg

SEQ ID NO: 364388 - DNA, 553 bp, Homo sapiens
  misc_feature: GZ8MTXP01BK0GS.52.28.C06.1.454.CMB.2.raw
  modified_base (286)..(286): a, c, t, g, unknown or other
  modified_base (291)..(291): a, c, t, g, unknown or other
  modified_base (341)..(341): a, c, t, g, unknown or other
  modified_base (468)..(468): a, c, t, g, unknown or other
  modified_base (527)..(527): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactactacactgggtncgacnggccccctggacaaagggcttgagtggatgggggtggaacaagtcccaanagtggaggcaccggtcgcacagaaatatagcgcgggaaagtttccgaaggggtcaaggggtcaccatcgaccagacgacaggtcccaactaacacagcctacatagagctaaagtagactgacatcngacgacacgggcctctattaattgttgtgagagaggacccgagttcgaacctcgaaccntcggacgtcgttcgggggaacccggg

SEQ ID NO: 364389 - DNA, 530 bp, Homo sapiens
  misc_feature: GZ8MTXP01BBDQA.52.28.C06.1.454.CMB.2.raw
  modified_base (211)..(211): a, c, t, g, unknown or other
  modified_base (224)..(224): a, c, t, g, unknown or other
  modified_base (245)..(245): a, c, t, g, unknown or other
  modified_base (486)..(486): a, c, t, g, unknown or other
  modified_base (493)..(493): a, c, t, g, unknown or other
  modified_base (509)..(509): a, c, t, g, unknown or other
tcagcgcagtacgacacgaccggtgctcgatttagagctcacgtattgggtttggggagcatcacccagcaaccacatctgtcctctagagaatccccagagagctccgttcctcaccatggactggacctggaggatcctcttcttggtggcagcagccacaggagcccactccctggagcgtctggtacaatctggactgaggtaaagngaccaggggcctnagtgaagtctcctgtagcttnggactacccataaccggctactactacactgggtgcgacaggcccctggacaagggcttgagtggatgggggtggaacatcccaacagtggaggcaccggtccgcacagaatatgcgcggaagtttcgagggcaggggtcaccatgacagcgacacggtccaactaacacacgcctacatggagcgtaacgtagactgacatctagaccgacgacggccgtctattaatgttgtcgagagngacccgnttacgaacctgaacgntgggaccgtgttcggggccgg

SEQ ID NO: 364390 - DNA, 567 bp, Homo sapiens
  misc_feature: GZ8MTXP01DRJO6.52.28.C06.1.454.CMB.2.raw
  modified_base (341)..(341): a, c, t, g, unknown or other
  modified_base (450)..(450): a, c, t, g, unknown or other
  modified_base (495)..(495): a, c, t, g, unknown or other
  modified_base (525)..(525): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtgcgacaggccccctggacaaagggcttgagtggagtgggggtgaacaatcccaanagtggaggcaccggtcgcacagaatagtgcgcggtaagtttcgaagggcaggggtcaccgatcgaccagcgacacgggtacccaactaacacacgcctaacagtagganacggtaaagtaggaactagacagtctcggaacgacgacgggcctnttattaattgttgtgagagaacggacccgngttacgaacctaggaactagtcgggacgtcgttgggggcccg

SEQ ID NO: 364391 - DNA, 545 bp, Homo sapiens
  misc_feature: GZ8MTXP01D74SA.52.28.C06.1.454.CMB.2.raw
  modified_base (226)..(226): a, c, t, g, unknown or other
  modified_base (442)..(442): a, c, t, g, unknown or other
  modified_base (463)..(463): a, c, t, g, unknown or other
  modified_base (506)..(506): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctcctgtaaggcttctggactacccataaccggctactactacactgggtgcgacaggcccctggacaaagggcttgagtggatgggggtggaacaatcccaaacgagtggaggcaccggtcgcacagaatatgcgcggaaagtttcgagggtcaggggtcaccatgaccagcgacagggtaccaactaacacagcctacatggganacgtaaagtagactgacatcngaacgactacggcctctattaattgttgtgagagaggacccgnttggaaccctagaacagtcggacgttcgaaggggcccgg

SEQ ID NO: 364392 - DNA, 643 bp, Homo sapiens
  misc_feature: GZ8MTXP01CE6BL.52.28.C06.1.454.CMB.2.raw
  modified_base (491)..(491): a, c, t, g, unknown or other
  modified_base (598)..(598): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactggaaggtaaagagaccgaggggcctacgaggtggaaggtctccgtaggtaaggtcttcgtaggactaccccataaccggctaactactacacgtgggtcgcgacgacggcccctggacaagggtcttagagtggagtgggggtagaacaacgtcccaagaggtggaggcgaaccggtccacacgagaatagtcggcggtcggtaagtttcggacggggtacgacggggtaccacagtacggaccgacgcggaacgacggtaccaacgtaaaccgacacgaccctaanaggtagacggtacgttaaaggtacggtacctagtactatacggtacgaaccgaccgtaccggggtccttactaagttaagtgttggtacgaggtagacggaccgttnacgtaaccacgaacgaggtcgacgggttaaccgggggtaacccgg

SEQ ID NO: 364393 - DNA, 636 bp, Homo sapiens
  misc_feature: GZ8MTXP01E1H4O.52.28.C06.1.454.CMB.2.raw
  modified_base (249)..(249): a, c, t, g, unknown or other
  modified_base (285)..(285): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttnggactaccccataaccggctactactacactgggtncgacaggcccctggacaagggcttgagtggagtgggggtaggaacaacgtcccaaacgaggtgggaggccgaaccgggtccgacacgaagaaactagtacggcggcggtaaagtttcgaggggcgaggggtcaccgatcgaccgaggcgaacgacggtcccaactaaaccgacaacgcccttaacgagtacgggacgacgttaaaggttacgaccgtagaacccagtcctacggaacgaccgacgggtcccgttacttagttaattggttggtaggagaacggaacgggacccgttattacgaaccctacgaacctaggtcgggaaccgttcgggttcggggaaccccggg

SEQ ID NO: 364394 - DNA, 528 bp, Homo sapiens
  misc_feature: GZ8MTXP01DBS4H.52.28.C06.1.454.CMB.2.raw
  modified_base (250)..(250): a, c, t, g, unknown or other
  modified_base (338)..(338): a, c, t, g, unknown or other
  modified_base (436)..(436): a, c, t, g, unknown or other
  modified_base (456)..(456): a, c, t, g, unknown or other
  modified_base (463)..(463): a, c, t, g, unknown or other
  modified_base (471)..(471): a, c, t, g, unknown or other
  modified_base (486)..(486): a, c, t, g, unknown or other
  modified_base (507)..(507): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggaccggacctggaggatcctcttcttggtggcagcagccacaggagcccactccctggagcgtctggtacaatctgggactgaggtaaagagaccaggggcctcagtgaaggcctctgtaaggcttcnggactaccccataaccggctactacttacactgggtgcgacaggcccctggacaagggcttgagtggatgggggtgaacagtcccaanagtggagcacggtcgccacagatatgacgacggaagtttcgaggggcaggggtcaccatcgaccagcgacaggtccaactaacacagcctacatgganctaagtacgactagacatcngacgacncggtcctntattatgtgttgagngagaccgattcgactgaaacngtgcgttcgtcgggcgaaggg

SEQ ID NO: 364395 - DNA, 607 bp, Homo sapiens
  misc_feature: GZ8MTXP01B1D0T.52.28.C06.1.454.CMB.2.raw
  modified_base (227)..(227): a, c, t, g, unknown or other
  modified_base (554)..(554): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaggtaaagagaccaggggcctnagtgaagtctctgtagcttctggactacccataaccggctactactacacgtgggtgcgacacggccccctggacgaagggcttggaggtggagtgggggtaggaacaactacccaacgagtggaggcaccggtcgaccacgagaatagtgacgcgggtaaagtttccgagggtcgacggggtcaaccgatacgaccaggcgacgacggtccaactaacacacgacctaacagtaggacgtacgtaaacggtagtacctaggacattccgagaccgacgaccgggtaccgttctattaagttggttgtagaggaggacggaccccgnttacgaacccgtacgaaaccgtggtcggacggtcgttcgggggtaaccccggg

SEQ ID NO: 364396 - DNA, 623 bp, Homo sapiens
  misc_feature: GZ8MTXP01BCRSD.52.28.C06.1.454.CMB.2.raw
  modified_base (227)..(227): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtggactgaggtaaagagaccgagggcctnagtgaaggtctcgtgtaaggcttctggactacccataccggctactactacacgtggtgcgacgacggccccgtaggaacgaagggtcgtaggaggtggaggtgggggtagaacgaactacccgaagaggtacggaggccgaccggtccgacgacgagaatgtacggacgcggtaagtttcgagggtcgagggtccacgtagtcgaccgagcgacgacggtaccaacgtaacacacgacctacagtaggactaggtaagacggtactagacagttacgacgaaccgacgtaccgggtacttacttaattgttagttggtagaaggaggaaccggacccgttagttaccgaacctacgaacgtcggtagggttaccgtcgggttcgggggaacccgg

SEQ ID NO: 364397 - DNA, 538 bp, Homo sapiens
  misc_feature: GZ8MTXP01BH2AK.52.28.C06.1.454.CMB.2.raw
  modified_base (483)..(483): a, c, t, g, unknown or other
  modified_base (503)..(503): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaagagaccaggggcctcagtgaaggtctcctgtaaggcttctggactaccccataaccggctactactacactgggtgcgacaggcccctggacaagggcttgagtggagtgggggtaggaacaatcccaacagtggaggcaccggtccgcacagaatatgcgcggaagtttcgaggggcaggggtcaccatgacagcgacacggtcaactaacacacgacctacatggagacgtaaagtagaaccttgacatcgtgacgacacggcgtctattntgttgtgagagaggacccgngttcgctcgaacagtggacgtcgttggggaaccgg

SEQ ID NO: 364398 - DNA, 634 bp, Homo sapiens
  misc_feature: GZ8MTXP01APX32.52.28.C06.1.454.CMB.2.raw
  modified_base (470)..(470): a, c, t, g, unknown or other
  modified_base (580)..(580): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactacccataaccggctactactacactgggtgcgacacggcccctggacaagggcttgagtggagtgggggtaggaacaactacccaacgaggtaggacggcgaccgggtccgaccaacgaacgaaatagtacgcggcgggtaaagtttccgaggggcgaaggggtcaaccgagtcgaccgagcgacgacggtaccaactaacactacgaccctanacgtaggaagaccgtaaaggtacgatacggaccagtctacggacgacccgacgggtacccgttacgttaatttaagttggttcggtagaggtaaacggcggttaacccgnttacggaaccctacggaactaagtcgggttaccgtcgggcgggggtaacccggg

SEQ ID NO: 364399 - DNA, 592 bp, Homo sapiens
  misc_feature: GZ8MTXP01DM9I1.52.28.C06.1.454.CMB.2.raw
  modified_base (553)..(553): a, c, t, g, unknown or other
  modified_base (567)..(567): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactggaaggtaaagagaccgaggggcctcagtgaaggtctcctgtaaggtcttctggactaccccataaccggctactactacacgtgggtgcgacaggcccctcggacaagggcttggagtgggagtgggggtaggaaacaatcccgaacgaggtggacggcaccgggtccgacaacagaaatagtacgcggcgggtaaagtttcgaggggtcgaggggtcaaaccatcgaccaggcgaacgacggtacccaactaacacacgacctacgataggacgacgtaaagtagactaggaactactcgagacgacaccgggcctctaagttaatgttggtgagagacgggacccngcgaactacgaacngtcgacgtcggttcgggaacccggg

SEQ ID NO: 364400 - DNA, 589 bp, Homo sapiens
  misc_feature: GZ8MTXP01C51HA.52.28.C06.1.454.CMB.2.raw
  modified_base (537)..(537): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtgcgacgacggccccctggacgaagggcttggagtggagtgggggtaggaacaactcccaaacgagtggaggcgaccggtccgcacgagaatagtagcgcggtaagtttcgaggggcgagggtcacgagtcgaccaggacgacgacggtacccaacgtaacacacgacctacgataggagacgtaagtagactagacatcgtagacgacgacggccgtctattaagttgttgtagagaacggcggaacccgngttacgaaccgtacgaaccgagtcgggttacgtcggttcgggggaacccggg

SEQ ID NO: 364401 - DNA, 749 bp, Homo sapiens
  misc_feature: GZ8MTXP01CURRW.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactactacactgggtgcgacacggcccctggacaaagggcttgagtggagtgggggtgaacaatcccgaacaggtgacggcaccggtcgcacagaatactgacgccgggtaagtttccgaaggggtcgaaggggtcaaacccgagtacgaacccgagggaccgaacgacgggttccccaaacgttaaacccaccaacggaccccttaaacgaacgttagggaacgtaaccgggttaaaaggtaacgggtaaccttaggaaccctaaattcccgttaggaaaacccggaccgaaccggggtaccccgttaaccgtttaaagttttaaagtttcggttgggtttacgggaagggtaaaccgggtacgggggaaaaccccccggttagttaaccccggaaaccccgtaaccgggtaaacccggttaagttacgggggttaaccccgggttttccgggttcggggggggtaaccccccggggg

SEQ ID NO: 364402 - DNA, 609 bp, Homo sapiens
  misc_feature: GZ8MTXP01DT5HO.52.28.C06.1.454.CMB.2.raw
  modified_base (248)..(248): a, c, t, g, unknown or other
  modified_base (524)..(524): a, c, t, g, unknown or other
  modified_base (597)..(597): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgagtaaagagaccaggggcctcagtgaaggtctctgtaagcttcnggactacccataaccggctactactacacgtggtgcgacgacggcccctggacaagggcttggagtggagtgggggtggaacactacccgaagaggtggaggccgaccggtccgacacgagaatagtacgcgcgggtaaagtttcgaggggcgaacggggtcaaccgtagtacgaccgaggaccgacacgggtacccaaactaacacgacgcctacgaactagggagaccgtaagttagactacgacacgttcgagaaccgactaccggcccgttntagtttaagttgttgtaggagaaggacggacccgttagttacgaaccctagaaccgaggtacggacgttcggngggggaacccgg

SEQ ID NO: 364403 - DNA, 574 bp, Homo sapiens
  misc_feature: GZ8MTXP01BLQP1.52.28.C06.1.454.CMB.2.raw
  modified_base (227)..(227): a, c, t, g, unknown or other
  modified_base (344)..(344): a, c, t, g, unknown or other
  modified_base (382)..(382): a, c, t, g, unknown or other
  modified_base (473)..(473): a, c, t, g, unknown or other
  modified_base (526)..(526): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctnagtgaaggtctcctgtaaggcttctggactaccccataaccggctactactacactgggtgcgacacggcccctggacaagggcttgagtggagtgggggtagaacactacccaagnggtggaggccgaccggtccgacacgaagaatagtgcgnggtaaagtttcgagggcagggtcacatcgaccagcgtacgacggacccaactaacacacgcctaacataggacacgtaagtagactagacngttcaggacaccgtacggcccttatattaattgagtgagtacggacgacccgngttcgaaccctacggaatagtcgggacgtcggttcgggggaacccggg

SEQ ID NO: 364404 - DNA, 812 bp, Homo sapiens
  misc_feature: GZ8MTXP01A9FHM.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaggtaaagagaccaggggcctcagtgaaggtctcctgtaaggcttctggactaccccataaccggctactactacacgtgggtcgcgacacggcccccgtaggaccgaagggcttggaggtggagtgggggtagaacaactcccgaaacgaggtaggacggccgaccgggtccgacaacgaagaaattacgtagggaccggtaacgggtaaaggttttaccggaagggggaccgtaaggggggttacccaaaccccgtaagttaccggaacccgaacggtacccggaaccgtaaccggggttaaccccgaaaccttaaaccgaaaccgacggtaaccccttaacgaagttacgggaacggtaaccggttaaaagggttaacggaacttacggaaccgtaactttccggtaacggtaaaccggaacccgtaccgggggttaccccgtttacctttaaaggttttaaacgtttagggttcgggttaacggaagggtaaacgggtaacccggggaaaccccggttagttaacccggaacccggttaacggaaacccgtagggttaccggggttaaccggtttcccggggaacggggggtaacccccgggg

SEQ ID NO: 364405 - DNA, 615 bp, Homo sapiens
  misc_feature: GZ8MTXP01A1V4S.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactggaaggtaaagagaccgaggggcctcgagtgaaggtctcctgtaggcttctggactaccccataaccggctactactacactgggtgcgacaggcccctggacaagggcttgagtggagtgggggtaggaacaatcccaagaggtggaggcaccgggtccgacacagaatatcggcgcgggaagtttcgaggggcaggggtcacagtcgaccaggcgacgaggtccaactaacacacgacctacagtaggacgacgtaaagtacgactaggaacatcgtagaccggacgtaccgggtccgtactagttaacgttggttgtaggaacggtaggaacgggaccccgagttaccggaacccgttcggaaaccgtggtacggggaccggttccgttaacggggggtaaccccgggg

SEQ ID NO: 364406 - DNA, 613 bp, Homo sapiens
  misc_feature: GZ8MTXP01BQQP5.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaggtaaagagaccgaggggcctcagtgaaggtctctgtaaggcttctggactacccataaccggctactactacacgtgggtgcgacacggcccctggacaagggctgagtggagtgggggtaggaacaactacccaaacgaggtggaggccgaccggtccgcgacgagaatagtagcggcggtaaagtttcgagggcgaggggtcaccgatcgaccaggacgacgacggtaccaactaaaccacacgccctaacgagtaggacgtacgtaaacggtacgtaacgacggaactacgtcctagaaccgaacgaccgggtacccgtacttaattaagttgttaggtgaggacggaacggttacccgattacgaaccgtcgaactagtcggaccgtcggttcgggaaccgg

SEQ ID NO: 364407 - DNA, 557 bp, Homo sapiens
  misc_feature: GZ8MTXP01CF8JI.52.28.C06.1.454.CMB.2.raw
  modified_base (292)..(292): a, c, t, g, unknown or other
  modified_base (340)..(340): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtgcgacnggccccctggacaagggcttgagtggagtgggggtgaacaatcccaanagtggaggcaccggtccgcacagaactagtagcgcggaagtttcgaggggcaggggtcacatgaccagcgacaggtccaactaacacacgcctacagtggagcgtaagtagactgacagtctgacgacacggccgtctattaattgttgtgacggtagacgggacccgttagttcgaaccctacgaacacgtgggaccgtcgttgggggaacccggg

SEQ ID NO: 364408 - DNA, 702 bp, Homo sapiens
  misc_feature: GZ8MTXP01AOPQY.52.28.C06.1.454.CMB.2.raw
  modified_base (226)..(226): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctggactgaggtaaagagaccgagggcctnagtgaaggtctcgtagtaaggtcttcgtggactacccataaccggctactactacacgtgggtgtgacgacggccccgtaggacgaagggtcttggaggtggaggtgggggtagaacaactcccaagaggtggaggccgaccggtccgacgacaagaatagtacggcggaacgggtaacgtttcgggaggggccgtaggggtaccacgaagtcgaaccgacggacgacgacggtaccaaacgtaacacaccgacctacgagtacgagacggtaagtacgactacgaactacgtacgtacgaaccggtaaccgaacccggggttcccttaacgtttaagtttaacggtttaggttagggttaacggaagggtaaacgggaaccggggttaaccccgttagttacccggaaccgttaaccgggaaacgttacgggttacgggaacccgggttccggggttcgggggtaaccccggggg

SEQ ID NO: 364409 - DNA, 589 bp, Homo sapiens
  misc_feature: GZ8MTXP01EBEYF.52.28.C06.1.454.CMB.2.raw
  modified_base (253)..(253): a, c, t, g, unknown or other
  modified_base (503)..(503): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactggaaggtaaagagaccaggggcctcagtgaaggtctcctgtaaggcttcnggactaccccataaccggctactactacactgggtgcgacacggcccctggacaagggcttgagtggagtgggggtaggaacaatcccaaacaggtggaggcaccggtccgcacagaactatgacgcggtaagtttcgagggcagggtcaccatacgaccagacgacgaggtccaactaacacacgacctacagtaggagacgtaaaggtagaacctgaacatcgtacgaaccgactaccggacccgttntaactttaagttggttggttagagaggacggacccgttgttacgaacctacgaactggtggaccgttcgggttcggggaacccggg

SEQ ID NO: 364410 - DNA, 630 bp, Homo sapiens
  misc_feature: GZ8MTXP01DD01C.52.28.C06.1.454.CMB.2.raw
  modified_base (250)..(250): a, c, t, g, unknown or other
  modified_base (284)..(284): a, c, t, g, unknown or other
  modified_base (591)..(591): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctgggactgaggtaaagagaccgaggggcctcagtgaaggtctctgtaagcttngacacccataaccggctactactacacgtgggtncgacgacggcccctggacgaagggcttgaggtggagtgggggtagaacaactcccgaacgaggtggacggcaccgggtccgaccaacgaggtaaatagtcggaccggtaacggggtaaaggttttacccggaagggggccgaacgggggtacccaaccgagtcgaccgacggacgacgacggtacccaaactaacacacgacctacagtacggaacgtacggtaaacgtacggaactacgaacctaagttcgacgaaccgaccgtaccgggtcctacttattaagttgttgtgagaggacgacccgnttacgaacctacgaacagcggacgtcggcggggaaccgg

SEQ ID NO: 364411 - DNA, 577 bp, Homo sapiens
  misc_feature: GZ8MTXP01BPFA0.52.28.C06.1.454.CMB.2.raw
  modified_base (251)..(251): a, c, t, g, unknown or other
  modified_base (337)..(337): a, c, t, g, unknown or other
  modified_base (353)..(353): a, c, t, g, unknown or other
  modified_base (505)..(505): a, c, t, g, unknown or other
  modified_base (529)..(529): a, c, t, g, unknown or other
  modified_base (544)..(544): a, c, t, g, unknown or other
tcagcgcagtacgacacgaccggtgctcgatttagagctcacgtattggggtttgggggagcatcacccagcaaccacatccgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttcnggataccccataaccggctactactacactgggtgcgacaggcccctggacaagggcttgagtggagtggggtagaacatcccaanagtggaggcacggtcnccgacagaatatgacgacggtaagtttcgagggcgagggtccaccagtcgaccagcgacgacgggtccaactaaacacacgacctaacagtaggaagactaagggtaagacttaggaactagtctcgaacgaacgaccggtcgtactagttntggtgttgagaggacggaacccgngttcgaccgtcgaancgtggacggttcgttcgggggccgtaacggggg

SEQ ID NO: 364412 - DNA, 581 bp, Homo sapiens
  misc_feature: GZ8MTXP01DS1Q5.52.28.C06.1.454.CMB.2.raw
  modified_base (367)..(367): a, c, t, g, unknown or other
  modified_base (431)..(431): a, c, t, g, unknown or other
  modified_base (476)..(476): a, c, t, g, unknown or other
  modified_base (517)..(517): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttctggactaccccataaccggctactactacactggtgcgacaggcccctggacaaggctggagtggagtggggtggaacatcccaacagtggaggcgaccggtccgcacagatatgcgnggagtttcgagggtcgaggtcacgatcgacagcgagacggtccaactacacacgctacagtganacgtaaagtagactagacagtctcgaacgtacaccgggtcccgtnttaattaagtttgttggttgaggtaacggtcgggaacccgngttacggtaacccgttacgaaccgtaaggttggaacgggttccggttcgggggtaaccccgggg

SEQ ID NO: 364413 - DNA, 701 bp, Homo sapiens
  misc_feature: GZ8MTXP01EVV9M.52.28.C06.1.454.CMB.2.raw
  modified_base (256)..(256): a, c, t, g, unknown or other
  modified_base (602)..(602): a, c, t, g, unknown or other
  modified_base (662)..(662): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactgaaggtaaagagaccgaggggcctgagtgaaggtctcgtgtaaggcttcgnggactacccataaccggctaactactacacgtgggtcgacgacgacggcccccgtaggaacgaagggcttagaggtagggaggttgggggtacggaaactaaaccgtaccccgaaagtaggtacgggacggaccgaacccgggtcggaccaacgaagaaacgtagtacgggaccgggtaacgggttaaacggttttcggaacggggtacgtacgggggttaccaaccgtaagtccgaaccgaacggaccggaacgaaccgggtaccctaaacgaaaccaccgaacggacccttaaccgaagttacggggaacgtaaccggttaaaggttaacgaccttagaacctntcgtacggaccgtacgaccggtcgtacttagttaagttgttgtggagacgacgggaccgngttacgaacgtacaagatcggacgtcggttggggaaccg

SEQ ID NO: 364414 - DNA, 578 bp, Homo sapiens
  misc_feature: GZ8MTXP01ENRS3.52.28.C06.1.454.CMB.2.raw
  modified_base (351)..(351): a, c, t, g, unknown or other
  modified_base (363)..(363): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctggactgaggtaaagagaccagggcctcagtgaaggtctctgtaagcttctggactacccataaccggctactactacactgggtgcgacaggcccctggacaagggctgagtggagtgggggtggaacactccaacagtgaggcaccggtccgnacagatatgcgnggagtttcgagggcaggggtacaccatcgacagcgacaggtccaactaacacacacctacagtaggaggactaaagtaggtactggaactactctgaacgaccgcgggtacccggttcgtaattaattggttggtggttagacggacgggacccgacttacggaacccttacgaaaccgtagtacggggaaccgtcggttcgggggtccccgggg

SEQ ID NO: 364415 - DNA, 620 bp, Homo sapiens
  misc_feature: GZ8MTXP01APFCL.52.28.C06.1.454.CMB.2.raw
  modified_base (342)..(342): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttctggactaccccataaccggctactactacactgggtgcgacaggcccctggacaagggcttgagtggagtgggggtagaacaatacccaanaggtggaggccgaccggtccgcacgagaatatgcggcggtaagtttccgaggggtcaggggtcacgatcgacagcgacacggtccaacgtaacacacgacctacagtacggagacggtaaagtagactaggactactctacggaccgaacgaccggtacccgttcttaatttaagttggttggttaggaggtaacgggtaacgggaccccgagttaccggaaccttacccggaaagtacgtacggggttaccgtccgggttcgggggtaaccccgggg

SEQ ID NO: 364416 - DNA, 536 bp, Homo sapiens
  misc_feature: GZ8MTXP01A4FX0.52.28.C06.1.454.CMB.2.raw
  modified_base (286)..(286): a, c, t, g, unknown or other
  modified_base (337)..(337): a, c, t, g, unknown or other
  modified_base (486)..(486): a, c, t, g, unknown or other
  modified_base (499)..(499): a, c, t, g, unknown or other
tcagcgcagtacgacacgaccggtgctcgatttagagctcacgtattgggtttggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtncgacaggcccctggacaagggcttgagtggatggggtggaacaatcccaanagtggaggcaccggtcgcacagaatatgcgcggaaagtttcgagggcaggggtcaccatgaccagcgacaggtccaacgtaacacagcctaacataggagcgtaagtagactagacaatctgacgcacggcgtctattaattgttgtgngagaggaccccgnttcgaacctgaacatggacgtcgttgggggaacccgg

SEQ ID NO: 364417 - DNA, 584 bp, Homo sapiens
  misc_feature: GZ8MTXP01AUFB3.52.28.C06.1.454.CMB.2.raw
  modified_base (525)..(525): a, c, t, g, unknown or other
  modified_base (540)..(540): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctggactgaggtaaagagaccaggggcctcagtgaaggtctcctgtaaggcttctggactaccccataacccggctactactacactgggtgcgacacggcccctggacaagggcttgagtggagtgggggtagaacactcccaacgaggtggaggccaaccgggtccgacaacgaggaatagtggccgcgggtaaagtttcgagggcgaggggtcaccgatcgaccaggcgacgacggtaccaactaacacacgacctacagtaggagacgtaagtagactgaacagtctggaccgacgccggtaccgtctattaacgttgttggtagngacggacggacccgngttacgaacctagaactggtggaccgtcggttcggggaacccgg

SEQ ID NO: 364418 - DNA, 672 bp, Homo sapiens
  misc_feature: GZ8MTXP01CARYF.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactggaggtaaagagaccgaggggcttcagtgaaggtctcctgtaaggcttctggactaccccataaccggctactactacactggtgcgacacggcccctggacaagggcttgagtggagtggggtaggaacaatcccaacgaggtggaggcgaccggtcgcacagaatagtcgcgcggtaagtttccgaggggcgacggggtcaccgatacgaccgagccgacgacggtaccaacctaacacacgaccttacgagtaggaagtacgtaaagtacgtaaccgttagaactagttaccgacggaacccggacgtaacccggggttcccgttacccgtttaatttaaacgtttgggttacggttacgggttaagggtaaacggcggggttaaaccccggttagttacggaacccgttacccggaaagtacgtacgggggttaccggttcgggttccgggggtaaccccggggg

SEQ ID NO: 364419 - DNA, 536 bp, Homo sapiens
  misc_feature: GZ8MTXP01APCXB.52.28.C06.1.454.CMB.2.raw
  modified_base (250)..(250): a, c, t, g, unknown or other
  modified_base (450)..(450): a, c, t, g, unknown or other
  modified_base (495)..(495): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttcnggactacccataaccggctactactacactgggtgcgacaggcccctggacaagggcttgagtggatgggggtggaacaatcccaacagtggaggcaccggtccgcacagaatatgcgcggaagtttcgagggcaggggtcacatgacagcgacaggtccaactaacacagcctacataggagcgtaaagtagactgacntctgacgacacggccgtctattaatgttgtgagagacggacccgnttcggaacctacgaacagtggacgtcgttcggggaacccgg

SEQ ID NO: 364420 - DNA, 702 bp, Homo sapiens
  misc_feature: GZ8MTXP01B40X4.52.28.C06.1.454.CMB.2.raw
  modified_base (216)..(216): a, c, t, g, unknown or other
  modified_base (250)..(250): a, c, t, g, unknown or other
  modified_base (632)..(632): a, c, t, g, unknown or other
tcagcgcagtacgacacgaccggtgctcgatttagagctcacgtattggggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactgaggtaaagngaccgagggcctgagtgaagtctctgtagtcttngactacccataccgctactactacacgtgggtgacgacgacggccccgtaggacgaagggtcttaggagtggagtgggggtaggaacaactacccgaacgaggtggacggcgacccggtaccgacaacgaagaaatagtacggacgtaacggggtaagtttacggacggggtacgtaggggtaccaaacccgagtacgaacccgacggacggaacgacgggtacccaaacgtaaaccgaaccaacgaccctaacgagtacgggtaacgtacgttaaaggtaacgacgtacggaactacgtacgtacgaaccgacgtaccggtcccgttacttagttaacgttggttggttaggaacggtaaacgggaacggttaaccccggngttaccggtaaccgttaccgaaagtaacggtcggggttaccggttaaccgggttcgggggtaaccccggg

SEQ ID NO: 364421 - DNA, 600 bp, Homo sapiens
  misc_feature: GZ8MTXP01BOA6L.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactggaggtaaagagaccgaggggcctcgagtgaaggtctcctgtaaggtcttctggactaccccataaccggctactactacactgggtgcgacgacggcccctggacaagggcttgagtggagtgggggtaggaacgaactcccaacgaggtggaggcgaccggtccgcacgagaatagtagcgcggtaagtttcgagggtcaggggtcacagtcgacagcgacgacggtaccaactaacacacgacctacgagtggagacgtaaagtacgactagacctagtctagaaccgacgaccggtaccgttacttaattaagttgttggttgaggaggacggaccccgttagttccgaaccgttacgaacctagtcgggacgtcggttcggggaacccgggg

SEQ ID NO: 364422 - DNA, 698 bp, Homo sapiens
  misc_feature: GZ8MTXP01BZWE8.52.28.C06.1.454.CMB.2.raw
  modified_base (292)..(292): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactgaggtaaagagaccgaggggcctgagtgaaggtctcgtgtagcttctggactacccataaccggctactactacacgtggtgcgacncggcccctggacgaagggtcttggagtggagtgggggtagaacaactacccgaagaggtgggacggccgaccggtccgaccgaacgagtaaatagtacggacggtaacgggtaaacgtttcgggacggggtacgtacggggtacccaaccgagtacggaacccgagggacccgacgaacgggtacccaaaccgttaaaccaaccgaacggtacccttaacgaacgttaggggaacgtacggtaaaggttaacgacgttacggaactaacgttccgtacgaaccggaccgtaccgggtacccgttacttaagttaagtttggttaggttacggaggtaacgggaacggacccgagttaccgtaacgtacgaacgtggtacggttacggtcgggcgggtaacccgggg

SEQ ID NO: 364423 - DNA, 646 bp, Homo sapiens
  misc_feature: GZ8MTXP01ARI62.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtgcgacacggcccctggacagggcttgatggagtgggggtagaacaatacccgaacgaggtggaggcgaccggtccgacacgagaatagtaggcgcggtaagtttcgagggcaggggtcacgatcgacagcgacgacggtaccaacgtaacacgacgacctaacagtagggacgtacgtaaaggtacgaactacggaactagtaccgtacggaaccggaaccgaccggggtacccgttaccgttaagtttaacgtttggttaggttggaaacggttaacgggaaccgggaaccccggttgttaccggtaacccttacgaaacgtaggtacgggaccggttcgggcgggggtaaccccgggg

SEQ ID NO: 364424 - DNA, 733 bp, Homo sapiens
  misc_feature: GZ8MTXP01EERYM.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactgaggtaaagagaccgaggggcctcgagtgaaggtctccgtagtaaggcttcgtggactaccccataaccggctactactacacgtggtgcgacgacggcccctggacgaaggctggaggtggagtgggggtagaacaactacccgaacgaggtacggacggaccgacccggtcccgacaacgaaggtaaatagtacggaccgggtaaccgggtaaagttttaccggaaggggtccgaacggggttacccgaaccgtaaacgttaccggaaccgaacgggtaccgaaacgtaaccgggttacccgaaaaccgttaaaccaccgaaaccggacccttaaaccgaagttacggggaaccgtaacggggttaaacggtaacggtaaccgttacggaactacgtccgtacggaaccgaacgtacccggggtactttaccgttaatttaaggttgttggtagaggacggaacgggacccgttgaccgtaaccgtacgaaccgtggtcgggacgtccgggttcggggtaacccgg

SEQ ID NO: 364425 - DNA, 551 bp, Homo sapiens
  misc_feature: GZ8MTXP01BOHOD.52.28.C06.1.454.CMB.2.raw
  modified_base (226)..(226): a, c, t, g, unknown or other
  modified_base (250)..(250): a, c, t, g, unknown or other
  modified_base (403)..(403): a, c, t, g, unknown or other
  modified_base (434)..(434): a, c, t, g, unknown or other
  modified_base (512)..(512): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctctgtaaggcttcnggactacccataaccggctactactacactgggtgcgacaggcccctggacaagggcttgagtggagtgggggtggaacaactcccaacgagtggaggcaccggtcgcacagaatatgcgcggaagtttcgagggcgagggtcaccatcgacnggcgacgaggtccaactaacacacgcctacntaggacgacgtaaagtaggactggacagtctgaaccgacgacggccgtctattaattgttgtgagaggacggacccgnttcgaacctcgaacagtggacgtcggttgggaacccggg

SEQ ID NO: 364426 - DNA, 633 bp, Homo sapiens
  misc_feature: GZ8MTXP01D2F1X.52.28.C06.1.454.CMB.2.raw
  modified_base (220)..(220): a, c, t, g, unknown or other
  modified_base (324)..(324): a, c, t, g, unknown or other
  modified_base (354)..(354): a, c, t, g, unknown or other
  modified_base (375)..(375): a, c, t, g, unknown or other
tcagcgcagtacgacacgaccggtgctcgatttagagctcacgtattgggttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgagtaagagcagggcctnagtgaaggtctcctagtagcttctggactacccataaccggctaactactacactgggtgcgacacggcccctggacaagggcttgagtggagtgggggtgaanaactcccaagagtggagaccgtaccggtcncagaacgtaatagtcgccggnggttaaacgtttccgaagggcgtaacgggtcaacctagtcgaacgagcgagacggtccaaacgtaacacacgacctaacagtcggagaccggtaagttaacgaccgtaggaactacgttacgtaggaaacccgtacgaaccggggtcccgtacctttaagttaacgtttgttaagggtagttaaggaaggaccgggaacccgttgttaccgtaacccgtcgaaaacgtggtacggaccgtcggcggggtaaccccggg

SEQ ID NO: 364427 - DNA, 555 bp, Homo sapiens
  misc_feature: GZ8MTXP01DMCNE.52.28.C06.1.454.CMB.2.raw
  modified_base (519)..(519): a, c, t, g, unknown or other
  modified_base (534)..(534): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaagagaccaggggcctcagtgaaggtctcctgtaaggcttctggactaccccataaccggctactacttacacgtggtgacgacaggcccctggacaaagggcttgagtggatgggggtggaacaatcccaacgagtggaggcaccggtccgcacagaactatgcgcggaaagtttcgaaggggtcaggggtcaccgatcgacagcgacgaggtccaactaacacacgcctacgatagggagacgtaaaggtagaacttagactatcgtagaccgacacggccgtctattaatggttgtgagagcggacgnttaggcctacgaacngtggacgtcgcggggaaccgg

SEQ ID NO: 364428 - DNA, 638 bp, Homo sapiens
  misc_feature: GZ8MTXP01BEZ2A.52.28.C06.1.454.CMB.2.raw
  modified_base (596)..(596): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttctggactaccccataaccggctactactacacgtgggtgcgacacggcccctggacgaagggcttgaggtggagtgggggtacgaacaactacccaacgaggtgggaggcgaccgggtccgaccacgaagaaatacgtacggaccgggtcggggtaaacgttttcggaacgggggcgtaacgggggttacccaaccgtaacgtacgaacccgaaggaccggacgacgggtaccctaaaccgtaaacaacgacgtaccaacgagtaggagacggtaaagtagaactagaacatcgtacgaccgactaccgggcctatattaagtgttgtaggagaggacggacccgngacgaacctagaaccagtggacgtcggttcggggaacccggg

SEQ ID NO: 364429 - DNA, 743 bp, Homo sapiens
  misc_feature: GZ8MTXP01AF4D3.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttctggactaccccataaccggctactactacacgtgggtgcgacacggcccctaggacgaagggcttggaggtggagtgggggtaggaaacaacgtcccgaaacgaggtgggacggccgaccgggtccgacacgaagaaatagtcggcggcgggtaaagtttccggaaggggcgagggggtaccaaccgtagtacgaacccgacggaccggaacgaccgggttacccaaaccttaaaccgaaccgaacggacccttaaccgagttagggaacgtacggttaaaggtacgtaacgttacggaacctacgttaccgtaacggaacccgaaccgtaacccggggtcccgtttaaaccttaagttttaaacgtttgggttaggttagggaagggtaaacgggtaaccggggaacccccggttagttaccgggtaacccttacggaaaacgtacgggttacggggacccggtttcggggccgggggtaacccccggggg

SEQ ID NO: 364430 - DNA, 549 bp, Homo sapiens
  misc_feature: GZ8MTXP01ENMKB.52.28.C06.1.454.CMB.2.raw
  modified_base (226)..(226): a, c, t, g, unknown or other
  modified_base (249)..(249): a, c, t, g, unknown or other
  modified_base (513)..(513): a, c, t, g, unknown or other
  modified_base (527)..(527): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagacaggggcctnagtgaaggtctctgtaggcttcnggactacccataccggctactactacactgggtgcgacaggccccctggacaagggcttgagtggagtgggggtagaacatcccaacagtggaggcgaccggtcgcacgagaatagtgcgcggtaaagtttcgagggcagggtcacagtgacagcgacacggtacccaactaaccacacgcccttaacagtggagacggtaaagtagaccgtagacatcctgaccgacaccggcgtctagttaattgttgtgcgagagacccgnacgaacctcgaacngcgggactcggttcgggaacgg

SEQ ID NO: 364431 - DNA, 717 bp, Homo sapiens
  misc_feature: GZ8MTXP01DUUVW.52.28.C06.1.454.CMB.2.raw
  modified_base (212)..(212): a, c, t, g, unknown or other
  modified_base (225)..(225): a, c, t, g, unknown or other
  modified_base (246)..(246): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgagtaaagngaccgagggcctnagtgaaggtctctgtaagctntggactacccataaccggctaactactacactgggtgcgacacggccccgtggaccaagggcttgaggtggagtgggggtagaacaagtacccaacgaggtggaggccaccggtccgcacaggaaatgtacggcgcggggtaaagtttcggaaggggccgaacgggggtcacccgtagtcgaccgaggcgacacggtacccaactaaacacgacgtacctaacgaagtagggaacgacggttaaaacggtacggtaaaccttacggaaactaacgtttccgtaaggtaaacccgtaaccgaaccgggggtaccccgtttaacgtttaacttttaaacggtttcggttaggggtttacggaaacgggtaagggtaaacccgggttaaccccgagtttaccgaaaccccggttacggaaacgttacggtacggggttaccggtttaacggggttccggggggtaaccccgggg

SEQ ID NO: 364432 - DNA, 581 bp, Homo sapiens
  misc_feature: GZ8MTXP01ESZNU.52.28.C06.1.454.CMB.2.raw
  modified_base (429)..(429): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccatccctggagcgtctggtacaatctggactgaggtaaagagaccaggggcctcagtgaaggtctcctgtaaggcttcgtggactaccccataaccggctactactacacgtgggtgcgacacggcccctggacaagggcttgagtggagtgggggtagaacaactcccaacgagtggaggcaccggtccgcacgagaatagtagacggcgggtaaagtttcgaaggggacgaggggtacacgatcgaccgagcgaacncggtaccaactaacacagcctacataggagacgtaagtagatgaactatctagaaccgacgtaccggtcccgtactaattaagttggttagttagagaagtacggacccgattacgaacctagaacagtcggacgtcgttcggggaacccgg

SEQ ID NO: 364433 - DNA, 693 bp, Homo sapiens
  misc_feature: GZ8MTXP01DSFIS.52.28.C06.1.454.CMB.2.raw
  modified_base (248)..(248): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccagggcctcagtgaaggtctctgtaagcttcnggactacccataaccggctactactacacgtgggtgcgacacggcccctggacaaagggcttgagtggagtgggggtgaacaactcccgaaacgagtggaggcaccggtcgccacagaatagtcgcgcgggtaagtttcgaggggcagggtcacatcgacaggcgacaggtacccaactaacacacgcctaacgagtagggacgtacgttaaaggtacgtaaccttaggaacctaacgttcgtacggaaacccgaaccgtaacccggggtacccggtttacctttaagttttaaacgttttcgggttaggttacgggttaaagggtaaacgggaacccggggttaaacccccggttagttaaccgggaaccccgtttaaacccggaaacgtaacggtaccgggggttaaccggttccgggttaaccgggggggtaacccccgggg

SEQ ID NO: 364434 - DNA, 666 bp, Homo sapiens
  misc_feature: GZ8MTXP01CO91F.52.28.C06.1.454.CMB.2.raw
  modified_base (631)..(631): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactggaaggtaaagagaccgaggggcctcgagtgaaggtctcctgtaaggcttctggactacccataaccggctactactacacgtgggtgcgacgacggcccctggacgagggcttaggagtgggagtagggggtacgaaactaacgtacccgaacgtaggtgggacgggcacccgggtccgaccgaacgagaatagtaggccggcgggtaaagtttcgagggacgaggggtccaaccgatacgacgagacgacgacggtccaactaacgacacgacctacgagtgggaacgtacggtaaaggtacgactacggaactacgtacgtacggaaccgtaaccgaccgggtcccgttaattaagtttaagttggttaggttcgaaagggtaacggacgggaaccccgttgaccgtaaccgtaccggaaacncggtagggacccggtcgggttcggggtaacccggg

SEQ ID NO: 364435 - DNA, 687 bp, Homo sapiens
  misc_feature: GZ8MTXP01CUMN3.52.28.C06.1.454.CMB.2.raw
  modified_base (227)..(227): a, c, t, g, unknown or other
  modified_base (249)..(249): a, c, t, g, unknown or other
tcagcgcagtacgacacgaccggtgctcgatttagagctcacgtattggggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaagtctcctgtaagcttntggactacccataaccggctactactacacgtggtgcgacacggcccctggacgaaggcttgagtgggagtggggtagaacactacccgaagacgtagggaacggccgaaccggggtccgaccgaacgaggaaatagtacggcgggcggtaaaggtttcgacggggtcaaggggtccaaccgagtcgaccgaggccgaacgacgggtacccaacgtaaaccacgaacgacctacgagttaggacgtacgtaaaggtacggaactacggactacgttcgacggaaccgaccgaaccggtcccggttaccttaagtttaagtttgggttacgggtggaaacggtaaggggtaaccgggaaccccggagttcggtaaacccgttacggaaaccgtagggtacgggttacccggttaacggggttcgggggtaaccccgggg

SEQ ID NO: 364436 - DNA, 672 bp, Homo sapiens
  misc_feature: GZ8MTXP01BIG1T.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaaggtaaagagaccgaggggcctcgagtgaaggtctccgtgtaaggcttcgtggactaccccataaccggctactactacacgtgggtcgcgacgacggccccgtaggacgaagggtcttaggagtggagtgggggtacgaacaacgtcccgaagaggtagggacggccgaccggtccgacacgaagaatagtcgacgcggtaagtttcgagggcgtagggtaccacatcgacaggacgacgacggtaccaaacgtaacacgacgacctacagtacggaacgtacgtaaagtacgacgtacgaactacgttacgacggaaaccgccgtaacccgggtcccgttacttaagtttaagttgttacggttagaaagggtacgggaaccggttaaccggttcgttacggtaacccgttacggaacgtagggtaccggttaaccgggtcgggttaaccgggggaaccccggg

SEQ ID NO: 364437 - DNA, 687 bp, Homo sapiens
  misc_feature: GZ8MTXP01ESPO1.52.28.C06.1.454.CMB.2.raw
  modified_base (296)..(296): a, c, t, g, unknown or other
  modified_base (660)..(660): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactggaagtaaagagaccgaggggcctcagtgaaggtctcgtagtaaggcttcgaggactaccccagtaaccggctactactacacgtgggtcncgacgacggccccgtggacgaagggtcttaggaggtggagtgggggtagaacaacgtaccccgaagaggtcggacggccgaccggtcgaccaacgagtaaatacgtaacgaccggtaacggggtaaagtttacgggacgggggtaccgtacgggggttaccaaccgtacgtacgaacccgaggaccgaaccgtaacgggtacccaaaccgtaaacgaccgaacggaccccttaagacgtacgggaacgtacggtaaacgtacggaacttacggaactacgttcgacggaacgtaccgtacggtcccgtatttagttaattggttagtggagaggaccgaccgttgttacgaaccgtacgaacgngtcggacggtcggttcgggaacccggg

SEQ ID NO: 364438 - DNA, 549 bp, Homo sapiens
  misc_feature: GZ8MTXP01E37TO.52.28.C06.1.454.CMB.2.raw
  modified_base (225)..(225): a, c, t, g, unknown or other
  modified_base (247)..(247): a, c, t, g, unknown or other
  modified_base (485)..(485): a, c, t, g, unknown or other
  modified_base (507)..(507): a, c, t, g, unknown or other
  modified_base (516)..(516): a, c, t, g, unknown or other
  modified_base (524)..(524): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttctggtggcagcagccacaggagcccactccctggagcgtctggtacaatctgggactgaggtaaagagaccaggggcctnagtgaaggtctctgtaagcttntggactacccataaccggctactactacactgggtgcgacaggcccctggacaagggcttgaggtggagtgggggtaggaaacaataccccaaacgaggtggaggcaccggtccgcacagaatatagcgcgggaagtttcgagggtcgaggggtcacgatcgacagcgacaggtcaacgtaacacagcctacatgagacgtaagtagactagaccatctagacacacggctcgtattntagttgtagagagaggacccgnttcgaaccnggaaaccngtcggacgtcgttcggggaacccgg

SEQ ID NO: 364439 - DNA, 682 bp, Homo sapiens
  misc_feature: GZ8MTXP01CPRF8.52.28.C06.1.454.CMB.2.raw
  modified_base (255)..(255): a, c, t, g, unknown or other
  modified_base (561)..(561): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgccccactccctggagcgtctggtacaatcgtgggactgaaggtaaagagaccgaggggcctcagtgaaggtctcctgtaagcttcnggactacccataaccggctactactacacgtgggtgacgacgacggccccctggaacgaagggtcttaggaggtggaggtgggggtacggaaactaacgttaccccgaaagtaggtgggacggtccgacccggggtccgaccaaacgtagaaattagtacgggaccggaacggggttaaacggtttcggaaacgggggtcgaaaggggttcccaaccgtaagtccgaacgacggaccgaacgaccgggttaacccaacgtaaccaacacgaccctagacgtaggagacgtaaagtagacctgaacnttcgagaaccgcgtaccggtccttatatttgtgttgtagaggaacggacggaacccgttgttaccggtaacctacggtaactacggtcgggttaacccgtcgggttcgggggaaccccggg

SEQ ID NO: 364440 - DNA, 644 bp, Homo sapiens
  misc_feature: GZ8MTXP01A2JEP.52.28.C06.1.454.CMB.2.raw
  modified_base (519)..(519): a, c, t, g, unknown or other
  modified_base (524)..(524): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagccccactcccgtggagcgtctggtacaatcgtgggactggaaggtaaagagaccgagggggcctacgaggtagaaggtctccgtaggtaacggcttcgtggactaccccataaccggctactactacactgggtgcgacacggcccctggacgaagggtctgagtggagtgggggtgaacaactacccaacgaggtggacggccgaccggtccgacacaagtaactaagtggaccggcgggtaaacgttttccgaggggtcgaggggtcaaccgagtacgaaccgaggacgacgacggtcccaaacgaacacacgacctacgagtaggagacggtaagtacgactaggacnttcgnggaccgaccgtaccggtccggtcttaagttaagttgttaggtggaggaacggacgggaccccgttgcgtaacccgtagaacccgagttacggggacgttaacgggccggggaacccgggg

SEQ ID NO: 364441 - DNA, 588 bp, Homo sapiens
  misc_feature: GZ8MTXP01EZM3H.52.28.C06.1.454.CMB.2.raw
  modified_base (222)..(222): a, c, t, g, unknown or other
  modified_base (280)..(280): a, c, t, g, unknown or other
  modified_base (549)..(549): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggagatcctcttcttggtggcagcagccacaggagcccactccctggagcgtctggtacaatctgggactgaggtaagagacagggcctnagtgaagtctctgtaagtcttctggactacccataaccggctactactacactgggtncgacacggcccctggacaagggctttggagtgggagtgggggtaggaaacaatacccgaaacgaggtaggaggccgaccggtccggacacgaagaatagtagcggcggtaaagtttcgaggggacgagggggtccaacccagtacgaccgacgcggaacgacggttaccaaacctaacacacgacctacagtagagaccgtaagtagactagaaccatcgtagaacgcgaccggtcctactattaatgttgtagagtacgaggacccgnttcgaacctagaactagcggagtcgttcgggggaacccg

SEQ ID NO: 364442 - DNA, 699 bp, Homo sapiens
  misc_feature: GZ8MTXP01AEEAR.52.28.C06.1.454.CMB.2.raw
  modified_base (253)..(253): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtggactggaggtaaagagaccgagggcctcgagtgaaggtctcctgtaaggcttcnggactaccccataaccggctactactacacgtggtgcgacacggcccctggacaagggtctggagtggagtgggggtagaacaatcccgaacgaggtggaggcgaccggtccgacacgagaatagtcgcggcggtaagtttccgaggggccgaggggtcaaccgagtcgaaccgaggacggacgacggtacccaacgtaaaccacgacgtacctaaccgagtacgggtaagacgggttaaaggtacggaccgttacggaacccagttccgtaacgggaacccggaaacccgtacccgggggtaccccggtttacctttaacgtttaacgtttaggttacgggttagggaaaggtaacgggtaaccgggaccccgttagttaccggaacccgttacgaaacgtacggtacgggttaccggttccgggttccgggggtaaccccgggg

SEQ ID NO: 364443 - DNA, 774 bp, Homo sapiens
  misc_feature: GZ8MTXP01D7627.52.28.C06.1.454.CMB.2.raw
  modified_base (227)..(227): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaggtaaagagaccgagggcctnagtgaaggtctctagtagcttcgtggactacccataccggctactactacacgtgggtcgcgacgacggcccctaggacgaagggcttgaggtggagtgggggtagaaacaacgtacccgaaacgtaggtcgggaacggccgaccgggtcccgacgacgaagtaaactacgtacggaccggtaacgggtaagtttaccgggacggggtaccgtaacgggggtacccaaccgtagttaccgggaaccgacgggaccgggaaccgtaaccgggttaaccccaaaccttaaaccgaaccgtaaccggacccttaacgaaggttacgggaacgtaaccggttaaaaggtacgtaacgtacgggaacctacgttaccgtacgaaccggaccgtaccggggtacccctttacgttaacgttttaacgtttcgggttagggtttacggaaggtaaacggggaaccgggttaaccccggttagttaccggtaacccgttaacgaacgtacggtacggggttaaccggttccgggttaaccggggggaaccccggg

SEQ ID NO: 364444 - DNA, 672 bp, Homo sapiens
  misc_feature: GZ8MTXP01AC5WW.52.28.C06.1.454.CMB.2.raw
  modified_base (255)..(255): a, c, t, g, unknown or other
tcagcgcagtacgacacgaccggtgctcgatttagagctcacgtattgggtttggggagcatcacccagcaaccacatctgtcctctagagaatccccagagagctccgttcctcaccatggactggacctggaggatcctcttcttggtggcagcagccacaggacgcccactccctggagcgtctggtacaatcgtggactgaggtaaagagaccgaggggcctcagtgaaggtctccgtagtaaggcttcgnggactacccataaccggctactactacgactgggtgcgacacggcccctggacaaggcttgaggtggagtggggtacgaacacgtacccaagaggtggaggcctaccgggtccacacgagaaactacgtacgggaccgtaacgggtaagttttacggaggggacgtaacgggggttacccaacccgtaagtaccgaaccggacgtaccggaaccgtaacgggttaccccaaaacgttaaccgaactacggtacccttaacgaacgtagggacgacggtttaaagcggtaactggaacctagtcgaggaccgaaccgtccgggtacttacttatttaagttggttgtagagacggtacggacccgttgacgaacccgtacgaaacgtgtcgggttacgtccgggcggggaaccccggg

SEQ ID NO: 364445 - DNA, 621 bp, Homo sapiens
  misc_feature: GZ8MTXP01B6IP8.52.28.C06.1.454.CMB.2.raw
  modified_base (224)..(224): a, c, t, g, unknown or other
  modified_base (249)..(249): a, c, t, g, unknown or other
  modified_base (382)..(382): a, c, t, g, unknown or other
  modified_base (558)..(558): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgagtaaagagaccagggcctnagtgaaggtctcctgtaaggcttcnggactacccataaccggctactactacactgggtgcgacacggcccctggacgaagggcttggagtggagtgggggtacgaacaactacccaagagtggacggcgaccggtccgacacgagaatagtagcggnggtaagtttcgagggcgagggtcacatcgacagacgacgagtaccaacgtaacacacgcctacagtggacgtacgtaaagtacggactacgaacagttcgacggaaccgacgtaaccggggtcccgttactaagtttaagttggttggttaggagtaacgggacgggttaccccgngttacgtaacccgtacggaaaccgtagtacggggttacgtccggggttcgggggaaccccggg

SEQ ID NO: 364446 - DNA, 574 bp, Homo sapiens
  misc_feature: GZ8MTXP01EOSNM.52.28.C06.1.454.CMB.2.raw
  modified_base (227)..(227): a, c, t, g, unknown or other
  modified_base (249)..(249): a, c, t, g, unknown or other
  modified_base (283)..(283): a, c, t, g, unknown or other
  modified_base (443)..(443): a, c, t, g, unknown or other
  modified_base (449)..(449): a, c, t, g, unknown or other
  modified_base (479)..(479): a, c, t, g, unknown or other
tcagcgcagtacgacacgaccggtgctcgatttagagctcacgtattggggtttgggggagcatcacccagcaaccacatctgtcctctagagaatccccagagagctccgttcctcaccatggactggacctggaggatcctcttcttggtggcagcagccacaggagcccactcccctggagcgtctggtacaatctggactgaggtaaagagaccaggggcctnagtgaagtctctgtaagcttcnggactacccataaccgctactactacactgggtnacgacacggcccctaggacaaagggcttagagtgggagtgggggtaggaaactaacgtacccgaaacgaggtaggaggcgaccggtccgcaacgagatatgcgcggagtttcgagggcagggtcacatcgacagcacgagtccaactacacacgacctanagtganacgtaagtagactagactatccgtagaacncgtaacggtccctattattaagttgttgtagagaacggacgacccggattcggaacctacgaaacgtgacgggacgttcggttgggggaacccgg

SEQ ID NO: 364447 - DNA, 557 bp, Homo sapiens
  misc_feature: GZ8MTXP01AWM9Y.52.28.C06.1.454.CMB.2.raw
  modified_base (225)..(225): a, c, t, g, unknown or other
  modified_base (250)..(250): a, c, t, g, unknown or other
  modified_base (286)..(286): a, c, t, g, unknown or other
  modified_base (468)..(468): a, c, t, g, unknown or other
  modified_base (477)..(477): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgagtaaagagaccaggggcctnagtgaaggtctcctgtaaggcttcnggactaccccataaccggctactactacactgggtncgacacggcccctggacgaagggcttgagtggagtgggggtagaacaatcccaacgaggtggagtcgaccggtccgacacagaatagtgcgcggaagtttcgagggcagggtcaccatcgaccaggcgacgacggtacccaacgtaacacacgcctacagtgagacgtaagtagactagacntcgagaccncgacggcctatattaagtgttgtgagacgacggacccagttacgaacctacgaacagtcggacgtcggcggggaacccgg

SEQ ID NO: 364448 - DNA, 727 bp, Homo sapiens
  misc_feature: GZ8MTXP01CO0SD.52.28.C06.1.454.CMB.2.raw
  modified_base (256)..(256): a, c, t, g, unknown or other
  modified_base (290)..(290): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgccccactcccctggagcgtctggtacaatctgggactggaaggtaaagagaccgaggggcctcagtgaaggtctcctgtaaggcttnggactacccataaccggctactactacagtgggngcgacgacggccccctggacgaagggtcttggaggtggaggtgggggtacggaaacctaacgtaccccgaaagtaggtgggacggtcgacccgggtccgaccaacgagaaatagtcgggaccggcgggtaaacgtttcggagggggtcgacgggggtccaccgagtcgaaccgagcgaacgacggtacccaacgtaaccacgacgaccttacgagtgggacgtacggttaaagtacgactacggaacctcgtacctaggacccggaaccgtaccggggtacccttacgtttaattaagtttgggttcggttaggaacggtaaacgggaccggggttaacccccgttggttacccggtaaccccttaacgggaacccgtaacggggttacggggttaaccccgggtttccgggttaaccggggggggtaacccccggg

SEQ ID NO: 364449 - DNA, 616 bp, Homo sapiens
  misc_feature: GZ8MTXP01AHARO.52.28.C06.1.454.CMB.2.raw
  modified_base (493)..(493): a, c, t, g, unknown or other
  modified_base (579)..(579): a, c, t, g, unknown or other
  modified_base (593)..(593): a, c, t, g, unknown or other
  modified_base (605)..(605): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggtcttctggactaccccataaccggctactactacacgtgggtcgcgacacggcccctggacaagggcttgagtggagtgggggtagaacactcccaacgaggtggacggcaccgggtccgacacgagaaatagtcggaccggtaacgggtaaacgtttcggaacggggtccgtaacgggggttccaaacccgtagtaccggaaccaggaccgaacgacgggttacccaacgtaacacgacgcctaanagtaggagacgtaaagtacgactacggaactagttcgagaccgacgtaccgggtcctagtattaatgttgtgagacgcggacccgnttcgaacctgaacngtcggacgtcgnggggaacccgg

SEQ ID NO: 364450 - DNA, 564 bp, Homo sapiens
  misc_feature: GZ8MTXP01EFYMN.52.28.C06.1.454.CMB.2.raw
  modified_base (227)..(227): a, c, t, g, unknown or other
  modified_base (246)..(246): a, c, t, g, unknown or other
  modified_base (491)..(491): a, c, t, g, unknown or other
  modified_base (521)..(521): a, c, t, g, unknown or other
  modified_base (539)..(539): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctgggactggaggtaaagagaccagggcctnagtgaggtctctgtagctngactacccataccgctactactacacgtggtgcgacacggccccgtggacgaaggtctgaggtggagtgggggtagaacgaactacccgaacgaggtggacggcgaccggtccgcacagaatagtgcgcggtaagtttccgagggcaggggtcacgatcgacaggcgacgacgtacaacgaacacacgacctaacgagtaggacgacgtaagtaagactagacatcagaacgaccacggcccgtnttattaagttgttgtgagacgaggacccgnttacggaacctagaacgngtcggacgtcggttgggaacccggg

SEQ ID NO: 364451 - DNA, 652 bp, Homo sapiens
  misc_feature: GZ8MTXP01D482H.52.28.C06.1.454.CMB.2.raw
  modified_base (252)..(252): a, c, t, g, unknown or other
  modified_base (339)..(339): a, c, t, g, unknown or other
  modified_base (414)..(414): a, c, t, g, unknown or other
tcagcgcagtacgacacgaccggtgctcgatttagagctcacgtattgggtttgggggagcatcacccagcaaccacatctgtcctctagagaatccccagagagctccgttcctaaccatggactggacctggaggatcctcttcttggtggcagcagccacaggacgcccactccctggagcgtctggtacaatcgtgggactgaggtaaagagaccgaggggcctcgagtgaaggtctcgtgtagcttngactacccataccggctactactacagtggtgcgacacggccctggacgaggcttggagtggagtggggtagaacaacgtcccaagnggtggacggccaccgggtcgaccaacgagtaactgtcggacgacgggtaagtttcgagggacgagggtaccacgngtacgaaccgaggtacgacgtacggtacccaactaaaccgacacggtacctacgagtacgggaacgtacgttaaaggggtacgtacgtacgactaacgttccgtacggacccgaacggtaccgggtccctttagttaagtttagtggttagttagggaaaggttagaaccggtaacccgagttccgaccgtaagaacgtgtacgggaccgttcggggtcggggttcccgtaacggggg

SEQ ID NO: 364452 - DNA, 729 bp, Homo sapiens
  misc_feature: GZ8MTXP01ADHJZ.52.28.C06.1.454.CMB.2.raw
  modified_base (298)..(298): a, c, t, g, unknown or other
tcagcgcagtacgacacgaccggtgctcgatttagagctcacgtattggggtttgggggagcatcacccagcaaccacatctgtcctctagagaatccccagagagctccgttcctcaccatggactggacctggaggatcctcttcttggtggcagcagccacaggacgcccactccctgggagcgtctggtacaatcgtggggactggaaggtaaagacgaccgaggggcctgagtgaaggtctctaggtaaggtcttctggactacccataaccggctactactcacgtgggtcncgacgacggcccctggaacgaagggtcttaggaggtggaggtagggggtacggaaactaacgtaccccgaaaggtaggtacggaacgggccgaaccggggtccgaccgaacgaaggtaaacttagcgggaccgggtaacgggttaaaggtttcccgggaaaggggccgtaacggggtaccacgtaaagtcggaaccgacggaccgaacgtaccgggtaccaaacggtaaccacgtacgaccttacgacgtaggagtaaccggttaaaggacgtactaacggaacctacgttacgaacggaaccgtaccgtaccggggttacccttagttaattaacggttggggttaggtacggaggaacggtaccgggacccttagaccgtaacccgacgtaagcggtacgggttaccgttcgggccggggtaaccgggg

SEQ ID NO: 364453 - DNA, 664 bp, Homo sapiens
  misc_feature: GZ8MTXP01EVJPP.52.28.C06.1.454.CMB.2.raw
  modified_base (249)..(249): a, c, t, g, unknown or other
  modified_base (621)..(621): a, c, t, g, unknown or other
  modified_base (636)..(636): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaggcttcnggactacccataaccggctactactacacgtgggtgccgacgacggccccctaggaaccgaaagggcgttggaggtggagttgggggtacggaaacaacgtaccccaaacgaggtagggacgggaccgacccgggtccgacgacgaagaaatagtaaggccggtaacgggtaaacgtttcggaacggggtcgacgggggttacaccgtaagtcggaacccgacggaccggaacgacgggttacccaaaccgttaaacgaccacgacctaacagtagacgtacgtaaaggtacgtacgtacgaaccagttccgagaaccggacgaccggtaccggttacttattaattggttgtaggttagacggtacgacgngcgaacctagaacgngtcgggacgtcggttcggggaacccggg

SEQ ID NO: 364454 - DNA, 669 bp, Homo sapiens
  misc_feature: GZ8MTXP01CPPCF.52.28.C06.1.454.CMB.2.raw
  modified_base (297)..(297): a, c, t, g, unknown or other
  modified_base (358)..(358): a, c, t, g, unknown or other
  modified_base (393)..(393): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaagtcgtgggactggaagggtaaagagaccgaggggcctcagtgaaggtctcgtagtaaggcttcgtggactacccagtaaccggctactactacacgtgggtcncgacgacggcccctaggacgaggtcttgagtggagtgggggtacgaactaactacccaagnggtaggacgcgacggtccgcacgagaatgaggcgnggtagttcgagggcacgggtcacagtacgacacgacgacgacggacccaacgtaaccacgacgtacctaacgagtacgggaacgtacggtaaaggtaacgtaccgtaggaacctagtacccgtagtaacccggaccgtaacccggggtcccgttatttaacgtttaacgttcgggttaggttacgggaaggtaacgggccggaaccccggttgttaccgtaacccgtacggtaaacgtcgggtagggacccggttcgggttccgggggaacccggg

SEQ ID NO: 364455 - DNA, 575 bp, Homo sapiens
  misc_feature: GZ8MTXP01DOPM7.52.28.C06.1.454.CMB.2.raw
  modified_base (541)..(541): a, c, t, g, unknown or other
  modified_base (558)..(558): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatcgtgggactgaggtaaagagaccgaggggcctcagtgaaggtctcctgtaaggcttctggactaccccataaccggctactactacacgtggtgcgacacggcccctggacaagggcttgagtggagtgggggtagaacaactcccaacgaggtggaggcgaccggtccgacacgaagaatagtgcgcgggtaagtttcgagggtcgaggggtccacgagtcgacgagcgacgaggtacccaactaacacgacgacctaacacgtaggacgtacgtaaaggacgtacgtagacagtcgtagaaccgtacgacggccgttctagttaatgttgtgagagcgaccgnttacggctacgaatagnggacgtgcgggaaccgg

SEQ ID NO: 364456 - DNA, 761 bp, Homo sapiens
  misc_feature: GZ8MTXP01BV4N6.52.28.C06.1.454.CMB.2.raw
  modified_base (250)..(250): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactggaaggtaaagagaccaggggcctcgagtgaaggtctctgtagcttntggactacccataccggctactactacacgtgggtcgcgacgacggccccgtaggacgaagggcttggaggtggacgtaggggggtacgaaactaactacccgaaagtaggtacgggacggcccgacccggggtcccgaccaaacgaaggtaaacttacggtaacgggaccggtaacgggggttaaacgtttaccgggaacggggggaccgtaccgggggttacccaacccgtaaggttaccggaaacccgacgggacccgaaacgtaaccggggtaccctaaaacctaaaccgaaccgtaaccgtaccctaacgtaggtacgggaaacgtacggttaaacggtacggtaacctacggaacgtactaccggttacgaaacccggtaccgtaccggggtacccgttatttaacgttaagtttggttaggtagacggtaacggaacgggttacccgattaccggaaccgttagaacgtcgtacggggttacgtccggttcgggggtaacccgg

SEQ ID NO: 364457 - DNA, 692 bp, Homo sapiens
  misc_feature: GZ8MTXP01EW5HR.52.28.C06.1.454.CMB.2.raw
  modified_base (252)..(252): a, c, t, g, unknown or other
  modified_base (289)..(289): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtggactgaaggtaaagagaccgaggggcctgagtgaaggtctctgtaaggcttntggactacccataccggctactactacacgtgggtcncgacacggccccgtaggacaagggtcttagaggtggagtgggggtacggaacaactcccgaagtaggtggacggccgaccggtcgaccagaagtaatagtcgcggtcgggtaaagtttccgggagggacgtagggggttccaaaccgttagtaccgaaccgacggtacgaacccgaacgggtaccccaaacgttaaaccgaaccgacgacccctaacgaggtacggacgtacggtaaagtaacgtaaccgtaggaacctagtacgtacggaaacccgaccggaccgggtacctacttaagtttaagttcgggttgtggaagacgggaaccgggacccgttgttaccggtaaccctaacgtaacgtaaggtccgggttaacgtccggggcggggtaaccccggg

SEQ ID NO: 364458 - DNA, 708 bp, Homo sapiens
  misc_feature: GZ8MTXP01ANB62.52.28.C06.1.454.CMB.2.raw
  modified_base (463)..(463): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacgaggacgcccactcccgtggagcgtctggtacaatcgtgggactggaaggtaaagacgaccgaggggccctgagtgaaggtctcgtgtaaggtcttcgtaggactacccaagtaaccggctaccttactacacgtgggtcgcgacgacggccccgtagacgaggtcttggaggtggaggtgggggtacgaaactaactaccccgaaagagggttcggaacggccgtaccgggtcccgacaagaagtaatacgtggcggtaacggtaagttcggacgggtcgacgggtcaacagtcgaacnggacgacgaacgtaccctaacaacgacgactccgaacagtacggaacgaaccgggttaaagtacgtaaccgtagactaccgttacggacgaaaccggttaccgacccgggttacgttaaccttaatttaaggtcgggtttaggtagaaacgggtaaacggaacggttaaccccttaggttaacccgtaaccgtaaccgaaagtcgggttacgggaccggttcgggaaccgggggttaacccgggg

SEQ ID NO: 364459 - DNA, 617 bp, Homo sapiens
  misc_feature: GZ8MTXP01B6Q9Y.52.28.C06.1.454.CMB.2.raw
  modified_base (253)..(253): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactggaaggtaaagagaccgaggggcctcagtgaaggtctctgtagtctcngacacccataccgctactactacacgtgggtgcgacgcggccccgtggacgagggtctggagtggagtgggggtagaacactcccaagaggtggaggcgaccggtccgacacgagtaatacgtacggcggtcgggtaaagtttcgacggggtcgacggggtaccaacgacgtcgacgacgacgacggtacgtacaaacgtaacgacaacgtcctaacgagtacgacgtaacgtaaggtaacgtactacggtaactacgttacgtacgaaaccggaccggtccggtaccgttacttagttaattcggttagtcgagacggacgccgagcgaacgtagaacgtgtggaccgtggcggggtaaccgg

SEQ ID NO: 364460 - DNA, 695 bp, Homo sapiens
  misc_feature: GZ8MTXP01EW3JK.52.28.C06.1.454.CMB.2.raw
  modified_base (229)..(229): a, c, t, g, unknown or other
  modified_base (253)..(253): a, c, t, g, unknown or other
  modified_base (287)..(287): a, c, t, g, unknown or other
  modified_base (292)..(292): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagccccactccctggagcgtctggtacaatcgtgggactgaaggtaaagagaccgagggcctnagtgaaggtctctgtaagcttcgngactacccagtaccgctactactacacgtggtcncgacncggcccctggacaagggcttgaggtggagtgggggtagacaactcccgaaacgaggtcggaacggccgaccggtcccgacaaacgagaaatgtaacgggcgtaacgggtaaacgtttcggaaacggggccgaacggggtaccaccgtaacgtaccgaacccgaggacccggaaacgacggtacccctaaacgtaaaccaacgaccggaccttaaacccgaagttaaggggaaacaccgggttaaaaggaaggtaacctacgggaaactacgttacgaacgaaccgggtaaactcccggggtccctaaacttagtttaagttggttggtagaaaggacggaacgggttaccccggattacggaacctacgaacgtgtcgggacgtcggttaacgggggaaccgg

SEQ ID NO: 364461 - DNA, 711 bp, Homo sapiens
  misc_feature: GZ8MTXP01BVID7.52.28.C06.1.454.CMB.2.raw
  modified_base (294)..(294): a, c, t, g, unknown or other
  modified_base (398)..(398): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactggaaggtaaagacgaccgaggggcctacgagtaggaaggtcctacctagtaaggtcttcgtggactacccataaccggctactactacncgtgggtgcgacacggcccctggacgaagggcttggagtggagtgggggtacgaacacgtacccaacgaggtaggacggcgaccggtccgacacgagaagtagnggaccggcggtaagttttaccggaggggtccgaacgggggttccaacgtacgtacggaaacccgacgggacggaaccggtacgggttaacccaaacgttaaaccgaaccgtaacgtacccgttaacgaacgttacgggaacggtacgttaaaacggttaacgacttacgggaacacgttacgtacggaaccgaccggtaccggtccggttacttaagttaagtttgttgttacggagtagggtaacgacccgttagttaccgaaccgttacgaacgtaggtacgggttaccgtcgggttccggggaaccgggg

SEQ ID NO: 364462 - DNA, 671 bp, Homo sapiens
  misc_feature: GZ8MTXP01DQ6KZ.52.28.C06.1.454.CMB.2.raw
tcagcgcagtacgacacgaccggtgctcgatttagagctcacgtattgggtttggggggagcatcacccagcaaccacatctgtcctctagagaatccccagagagctccgttcctcaccatggactggacctggaggatcctcttcttggtggcagcagccacaggagcccactcccctggagcgtctggtacaatcgtgggactggaaggtaaagacgaccgaggggcctcgagtgaaggtctcctgtaaggcttctggactacccagtaaccggctactactacgactgggtgcgacacggcccctggacaagggcttgagtggagtgggggagaacactacccaacgagtcggaggccaaccgggtccgacgaacgaaggtaaatagtacgggacggtcgggtaaagttttccgaagggggtactacgggggtcaaccggatacgaacccgaaggccgaacgacgggttaacccaaaacgttaaccaacgacggtaccttaacagtacgggaacgtacgtaaacggtaggaacttacgaaccatcgtacgaacgtaccgtaaccggtcgtacttaagttaagttgttaggtggaagagggtacggaacccgttgttaaccgccgtacgaacgtagtcgggttacgtcgggttaacggggaacccggg

SEQ ID NO: 364463 - DNA, 518 bp, Homo sapiens
  misc_feature: GZ8MTXP02HQYY1.52.28.C06.1.454.CMB.2.raw
  modified_base (370)..(370): a, c, t, g, unknown or other
  modified_base (452)..(452): a, c, t, g, unknown or other
  modified_base (481)..(481): a, c, t, g, unknown or other
  modified_base (502)..(502): a, c, t, g, unknown or other
tcagcgcagtacgacacgaccggtgctcgatttagagctcacgtattgggtttggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctcagtgaaggtctcctgtaaggcttctggataccccataacccggctactacttacactgggtgcgacaggcccctggacaagggcttgagtggatggggtggaacaagtcccaacagtggaggcaccggtccgcacagaatatgngcggaagtttcagggcaggggtcacatgaccagcgacaggtccactaacacagcctacatggagctaagtagactgacatcngacgcacggcgtctattatgtgtgagagngacccaatgaacctcgaacanggactcgtcgggaccg

SEQ ID NO: 364464 - DNA, 526 bp, Homo sapiens
  misc_feature: GZ8MTXP02G7512.52.28.C06.1.454.CMB.2.raw
  modified_base (433)..(433): a, c, t, g, unknown or other
  modified_base (451)..(451): a, c, t, g, unknown or other
  modified_base (518)..(518): a, c, t, g, unknown or other
tcagcgcagtacgacacgaccggtgctcgatttagagctcacgtattgggtttggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaaggcttgagtggatggggtggaacaatcccaacagtggaggcaccggtccgcacagaatatgcgcggaaagtttcaggggcaggggtcaccatgaccagcgacaggtcccataacacagcctacatgganctaagtagactgacatcngacacacggccgtctattatgtgtgagagacggacccaatcgaacctcggaaacactggacgttcgnggggaccg

SEQ ID NO: 364465 - DNA, 559 bp, Homo sapiens
  misc_feature: GZ8MTXP02JGXGD.52.28.C06.1.454.CMB.2.raw
  modified_base (446)..(446): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtggatggggtggaacatcccaagagtggaggcacggtccgcacagaatatgcgcgggaaagtttcgaggggtcaggggtcaccgatcgaccagcgacgaggtcccaactaacacacggaccctacatagganacttaagagactgacatctagacgacacggcgtactatttactgtagtagagacggacgacccgtatcggaacctacggaaactagtacgggacgtcggtacgggggacccgg

SEQ ID NO: 364466 - DNA, 535 bp, Homo sapiens
  misc_feature: GZ8MTXP02JNCPJ.52.28.C06.1.454.CMB.2.raw
  modified_base (455)..(455): a, c, t, g, unknown or other
  modified_base (470)..(470): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacactgggtgcgacaggcccctggacaagggcttgagtggatggggtggaacaatcccaacagtggaggcaccggtccgcacagaatatgcgcgggaagtttcagggcaggggtcaccatgaccagcgacaggtccaactaacacagccacataggagactaagtagactgacatcngacgacacgggcctntattagttgtgtagagaggacggacccagtcgaacccgtgaacatggaccgtcgcggggacccgg

SEQ ID NO: 364467 - DNA, 551 bp, Homo sapiens
  misc_feature: GZ8MTXP02GACJU.52.28.C06.1.454.CMB.2.raw
  modified_base (429)..(429): a, c, t, g, unknown or other
  modified_base (434)..(434): a, c, t, g, unknown or other
  modified_base (462)..(462): a, c, t, g, unknown or other
  modified_base (470)..(470): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaagggcttgagtgagtggggtggaacatccaacgagtgagcacggtcgacacagatatgcgcggaagtttcgaagggccagggtacaccatcgaccagcgacaggtcccaactaacacagcctaantgganactaagtagactgacatctagacgaacncgaccgtntattaattgtaggtgaaggagacggggaaccctagacgaaccgttcggaaactacgaggttacgcgttacggggacccggg

SEQ ID NO: 364468 - DNA, 531 bp, Homo sapiens
  misc_feature: GZ8MTXP02H8Y5O.52.28.C06.1.454.CMB.2.raw
  modified_base (226)..(226): a, c, t, g, unknown or other
  modified_base (495)..(495): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctcctgtaaggcttctggactaccccataaccggctactacttacactgggtgcgacaggcccctggacaagggcttgagtggagtggggtggaacaatcccaacagtggaggcaccggtcgcacagaatatgcgcggagtttcagggcaggggtcacatcgacagcgacaggtccaactaacacacgacctacatggagactaagtagactgacatctgacgacacggcgtctattatgtgtgagagacggaccgtagngaaccgtcgaacagtggacgtcgtacgggacccggg

SEQ ID NO: 364469 - DNA, 530 bp, Homo sapiens
  misc_feature: GZ8MTXP02JQULN.52.28.C06.1.454.CMB.2.raw
  modified_base (226)..(226): a, c, t, g, unknown or other
  modified_base (251)..(251): a, c, t, g, unknown or other
  modified_base (338)..(338): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctcctgtaaggcttcnggataccccataaccggctactacttacactgggtgcgacaggcccctggacaagggcttgagtggatggggtggaacaatcccaanagtggaggcacggtccgcacagaatatgcgcgggaagtttcaaggggcaggggtcaccatgaccagcgacaggtccactaacgacagcctacatggagctaagtagactagacatctgacgacacggccgtctattattgtgtgagagaggacccgatgaacctcgaaacagtggacgtcgtcggggaccgg

SEQ ID NO: 364470 - DNA, 541 bp, Homo sapiens
  misc_feature: GZ8MTXP02GDQLN.52.28.C06.1.454.CMB.2.raw
  modified_base (251)..(251): a, c, t, g, unknown or other
  modified_base (440)..(440): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcnggactaccccataaccggctactacttacactgggtgcgacaggcccctggacaagggcttgagtggatggggtgaacaatcccaaacagtggaggcaccggtccgcacagaatatgcgcggaaagtttcgaggggcaggggtgaccatgaccagcgacaggtccaactaacacacgcctaacatgganctaagtagactgacatctgacgacacggcgtctattattgtgtgaagacgacggaacccaagtcgaaccgtacgaactagtggacgtcgtcggggacccgg

SEQ ID NO: 364471 - DNA, 525 bp, Homo sapiens
  misc_feature: GZ8MTXP02J1ZO6.52.28.C06.1.454.CMB.2.raw
  modified_base (365)..(365): a, c, t, g, unknown or other
  modified_base (369)..(369): a, c, t, g, unknown or other
  modified_base (432)..(432): a, c, t, g, unknown or other
  modified_base (447)..(447): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacactgggtgcgacaggcccctggacaagggcttgagtggatggggtgaacaatcccaacagtggaggcaccggtcgcacagaatangcgnggaagtttcagggcagggtcaccatgaccagcgacaggtccacgtaacacagcctacatgganctaagtagactgacntctagacgacacggctctattatgtgtgagacgacgacccgatcgaacctacgaacagtcggacgtcggcggacccgg

SEQ ID NO: 364472 - DNA, 539 bp, Homo sapiens
  misc_feature: GZ8MTXP02HTHA3.52.28.C06.1.454.CMB.2.raw
  modified_base (226)..(226): a, c, t, g, unknown or other
  modified_base (250)..(250): a, c, t, g, unknown or other
  modified_base (400)..(400): a, c, t, g, unknown or other
  modified_base (489)..(489): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctctgtaaggcttcnggactaccccataaccggctactacttacactgggtgcgacaggcccctggacaagggcttgagtggatggggtaggaacaatcccaaacagtggaggcaccggtccgcacagaatatgcgcggaagtttcaggggcaggggtcaaccangaccagcgaacacggtccaactaacacacgacctacataggagactaaagtagactgacatactgacgacacggcgtctattatgttgngagagacgacccgatcgaacctcgaaacataggacgtcgtaggggcccgg

SEQ ID NO: 364473 - DNA, 643 bp, Homo sapiens
  misc_feature: GZ8MTXP02GY1CW.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacactgggtgcgacacggcccctggacagggcttgagtggagtggggtaggaacaactcccgaaacgaggtaggaggccgaccggtccgacgacaagaatagtcggacgcgggaagtttcgaggggcgaagggggtacacccgagtacgaacccgaggacgaaccgacgggtaaccccaaactaaacccaacgaacgaccctaacgagttagggagaaccgttaaaggtacgacttaggaacaactcaggaccgacgaccggtacccgtataagtttacgttggtagttcggaaaggacgacgggacccgagttacgaacccgttaacgaaaccaggtacggaccgttcggtacggggacccggg

SEQ ID NO: 364474 - DNA, 542 bp, Homo sapiens
  misc_feature: GZ8MTXP02HR9T4.52.28.C06.1.454.CMB.2.raw
  modified_base (338)..(338): a, c, t, g, unknown or other
  modified_base (363)..(363): a, c, t, g, unknown or other
  modified_base (409)..(409): a, c, t, g, unknown or other
  modified_base (442)..(442): a, c, t, g, unknown or other
  modified_base (480)..(480): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttctggactacccataaccggctactacttacactgggtgcgacaggcccctggacaagggcttgagtggatggggtgaacaatcccaangtggaggcaccggtcgcacagaatntggcgcggtaagttcaggggtcaggggtcacatgaacccagcgacnggtacccataaaccacagccctacgataggganactaaagtagactgaaccatctgacgacgacggccgtnttattattgtagtgaagagacggacccgatgaacctgaacagtggacgtcgtggggacccgg

SEQ ID NO: 364475 - DNA, 620 bp, Homo sapiens
  misc_feature: GZ8MTXP02I00DU.52.28.C06.1.454.CMB.2.raw
  modified_base (339)..(339): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataacccggctactacttacactgggtgcgacaggccccctggacaaggcttgagtggatggggtgaacaatcccaanagtggaggcaccgggtccgcacagaactagtgcgcgggaagtttcgaggggcaggggtcaccatgaccagcgacgaggtccaactaacacagtccacatacggagactaaaggtagacgttaggaactaacttcgacggaaccggacaccggggtccccgttattacgtttaacgttggttggttacggaacggaagggacggggaacccccgtagttaccggaaccgtacgggtaaaaccaggttcggggaaaccggttcggttcgggggaaccccgggg

SEQ ID NO: 364476 - DNA, 518 bp, Homo sapiens
  misc_feature: GZ8MTXP02FNX0I.52.28.C06.1.454.CMB.2.raw
  modified_base (337)..(337): a, c, t, g, unknown or other
  modified_base (454)..(454): a, c, t, g, unknown or other
  modified_base (485)..(485): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactggggtgcgacaggcccctggacaagggcttgagtggatggggtgaacatcccaanagtggaggcacggtccgcacagatatgcgcgaagtttcagggcaggggtcaccatgaccagcgacaggtcccactaacacagcctacatggagctaagagactgacatctgacgacncggccgtctattatgtgtgagagaggacccntacgaacctcgaacatggacgtcgtggggaccg

SEQ ID NO: 364477 - DNA, 563 bp, Homo sapiens
  misc_feature: GZ8MTXP02G0HAQ.52.28.C06.1.454.CMB.2.raw
  modified_base (454)..(454): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacacgtgggtgcgacacggcccctggacaaggcttgagtggagtggggtagaacaactcccaacgaggtggaggcgaccggtccgacacgagaatatggcgcgggtaagtttcgagggtcaggggtcaccagtacgaccagacgacgacggtacccaacgtaaccacacgacctanagtaggagactaagtagactagacatcgtacgacgacgacgtcgtactagttatgtgtgagacgtacgaccgtatcgaaccgtcgaacagtggacgtcgtcgggaccgg

SEQ ID NO: 364478 - DNA, 573 bp, Homo sapiens
  misc_feature: GZ8MTXP02HUKBG.52.28.C06.1.454.CMB.2.raw
  modified_base (226)..(226): a, c, t, g, unknown or other
  modified_base (342)..(342): a, c, t, g, unknown or other
  modified_base (456)..(456): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgagggcctnagtgaaggtctcctgtaaggcttctggactaccccataaccggctactacttacacgtgggtgcgacacggcccctggacaagggcttgagtggagtggggtagaacaatcccaanagtggaggcgaccggtccgacacagaatatcgcgcgggtaagtttcgaggggccgaggggtcaaccgtagtcgaaccgagcgaacgacggtacccaactaaccacacgacctanagtaggagacgtaaagtagactagactatctagacgacgacggtccgtctattatgttgtgagagacggaccagtcgaaccgtacgaactacgtaggacgtcggtacggggacccgg

SEQ ID NO: 364479 - DNA, 585 bp, Homo sapiens
  misc_feature: GZ8MTXP02IAZ9U.52.28.C06.1.454.CMB.2.raw
  modified_base (226)..(226): a, c, t, g, unknown or other
  modified_base (546)..(546): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctgggactgaggtaaagagacgagggcctnagtgaggtctctgtaaggcttctggactacccataaccggctactacttacactgggtgcgacacggcccctaggacaagggcttggagtggagtggggtaggaacaacgtacccaagaggtggacggccgaccgggtccgaccgaacgagaaatagtacggcgcgggtaacgtttcgaggggtccgaggggtcaaccgagtacgaccaggacgacgacggtacccaacgtaaaccacgacgacctacgagtaggagacgtaagtagactagacatcagacgacgacgcgtctattagtgtagtgagacgacgaccgtanacgaaccgtacgaactagtcggacgtcgacggggaccgg

SEQ ID NO: 364480 - DNA, 529 bp, Homo sapiens
  misc_feature: GZ8MTXP02JCJM3.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataacccggctactacttacactgggtgcgacaggcccctggacaagggcttgagtggatggggtggaacaatcccaacagtggagcgaccggtcgcacagatatgcgcggaatttcgagggcagggtcacatgaccagcgacaggtccactaacacagcctacatggagacgtaagtagactgacagtctgacgacacggcgtactattatgtgtgagacgacggacccgatcggaacctcgaacagtggacgttcgacggggaccgg

SEQ ID NO: 364481 - DNA, 549 bp, Homo sapiens
  misc_feature: GZ8MTXP02F8SDV.52.28.C06.1.454.CMB.2.raw
  modified_base (287)..(287): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtncgacacggcccctggacaagggcttgagtggagtggggtggaacatccaacagtggagcacggtccgcacagaatatgcgcgggtaagtttcgaggggtcaggggtacaccgagtcgaccaggcgaacgaggtcccaacgtaacacacgcctacatagggacactaaagtagactagacacttcagacgacacgggactctattagtgtgtgagagacggaccgatcgaaccgtcgaacagtcggacgttcgagggacccgg

SEQ ID NO: 364482 - DNA, 558 bp, Homo sapiens
  misc_feature: GZ8MTXP02GM1M3.52.28.C06.1.454.CMB.2.raw
  modified_base (288)..(288): a, c, t, g, unknown or other
  modified_base (405)..(405): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacactgggtncgacaggcccctggacaggcttgagtggatggggtgaacaactccaacagtggaggcaccggtcgcacagaatatgcgcggtaagttcgaggggcaggggtcaccatcgacagcganacggtccaactaaccacaacgccctaacagtagggaacacttaaaggtagacctaggaacatcgtgaaccgacacggccgtctaattagttgtgtgagacggtacggacccgatcgaacctacgaaactagtggaccgtcggtcggggaccgg

SEQ ID NO: 364483 - DNA, 589 bp, Homo sapiens
  misc_feature: GZ8MTXP02GOZHH.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttctggactaccccataacccggctactacttacactgggtgcgacacggcccctggacgaagggcttggagtggagtggggtagaacaatacccaacgagtggaggcaccggtccgacacgagaatagtcgcggcgggtaagtttcgaggggcgaggggtccaaccgagtacgaccgaggccgaacgacgggtacccaactaaaccacacgacctacagtaggaagactaagtagactgacagtctagacgacgacggtccgtactattagttgtagtgacggacgacggacccgagtcgaaccgtacgaactacgtggaccgtcggtacggggacccgg

SEQ ID NO: 364484 - DNA, 547 bp, Homo sapiens
  misc_feature: GZ8MTXP02GL1VA.52.28.C06.1.454.CMB.2.raw
  modified_base (251)..(251): a, c, t, g, unknown or other
  modified_base (437)..(437): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcnggataccccataaccggctactactacactgggtgcgacaggcccctggacaagggcttgagtggatggggtgaacaatcccaacagtggaggcacggtccgcacagaatagtgcgcggaagtttcgaggggcaggggtcaccatgaccagcgaacaggtcccacgtaacacacgcctacatgganacgtaagtagactagacagtctgacgacacggccgtctattacttgtgtgaggagacggacccgagtcgaaccgtacggaaactagtcggacgttacgcggggaacccgg

SEQ ID NO: 364485 - DNA, 565 bp, Homo sapiens
  misc_feature: GZ8MTXP02H3Q2C.52.28.C06.1.454.CMB.2.raw
  modified_base (226)..(226): a, c, t, g, unknown or other
  modified_base (500)..(500): a, c, t, g, unknown or other
  modified_base (522)..(522): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctcctgtaaggcttctggactacccataaccggctactacttacactgggtgcgacaggcccctggacaagggcttgagtggagtggggtaggaaacgaatacccgaaacaggtagggaggccgaccggtcccgcgaaccaggaaattaatggacgcggaaagttttcgaagggcgaggggtcaccgatagacccagacgacaagggcccaactaaacacagaccctacaagtaggagtacctaagtagactgacatcagacganacggctacgtattatgtgtganagacgaccgatcgaacgtcgaaacagtgacgtcgacgggccgg

SEQ ID NO: 364486 - DNA, 665 bp, Homo sapiens
  misc_feature: GZ8MTXP02HZ4W0.52.28.C06.1.454.CMB.2.raw
  modified_base (252)..(252): a, c, t, g, unknown or other
  modified_base (345)..(345): a, c, t, g, unknown or other
  modified_base (543)..(543): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctgggactggaggtaaagagaccgaggggcctcagtgaaggtctctgtaggcttcnggactacccataaccggctactacttacactgggtgcgacacggcccctggacaagggcttgagtggagtggggtagaacaacgtcccaaagnggtggacggccgaccggtccgacgaaccaggaattagcggacgcggggttaagtttcgacgggggtaccgtacggggtccaaccgtagtaccgaaaccgtacggaccggtaaccgaaccggggttacccaaaacccgttaaaaccgacgaaccggacccttaacgagtacgggacgtaacgttaaaggtacaccgtanacgtacgtacgtacgacgaccgaccggtaccgtacgttacgttacgttggttagtagacggacggacggaccgacgtacgtaaccgtacgaacgtacgtacggtacggtcggtacgggcggg

SEQ ID NO: 364487 - DNA, 545 bp, Homo sapiens
  misc_feature: GZ8MTXP02JHN4J.52.28.C06.1.454.CMB.2.raw
  modified_base (251)..(251): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcnggactaccccataaccggctactacttacactgggtgcgacaggcccctggacaagggcttgagtggatggggtggaacatcccaacagtggaggcacggtccgcacagaatatgcgcggaagtttcaggggcaggggtcacatgaccagcgaacgaggtccactaaacacacgcctacagtaggagactaacgtagacctaggacatctgacgacacggacgtctattagttgtgtgagagacggacccgagtacgaaccgtacgaactagtggacgtcgtacggggacccgg

SEQ ID NO: 364488 - DNA, 570 bp, Homo sapiens
  misc_feature: GZ8MTXP02IIE54.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacactggtgcgacaggcccctggacaagggcttgagtggagtggggtaggaacaatcccaaacgaggtggaggcgaccggtccgcacagaatatgcgcgggaagtttcgagggcgaggggtcaaccagtgaccagcgaacaggtacccaacgtaacaacagacctacagtgagactaagtagactagacatactagacgacgaccggccgtcgtaattagttgtgtgaggaacgacggacccgagtcgaaccgtacgaaactacgtacggtaccgtcggtacggggacccgg

SEQ ID NO: 364489 - DNA, 624 bp, Homo sapiens
  misc_feature: GZ8MTXP02FKKN0.52.28.C06.1.454.CMB.2.raw
  modified_base (287)..(287): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtncgacacggcccctggacgaaggcttggagtggagtggggtagaacaacgtcccaacgaggtggaggcgaccggtcccgacacagaatagcggcggcggtaagtttcgaggggcgaggggtcaccagtcgaccgagcgacgaggtacccaactaaccacgacgaccctacacgtagggaagacgttaaaaggtacgaaccgtaggaacctagtcgtagaaccgaacgaccgggtaccgttacttaagtttacttggtaggtaggaagaggaacgggacccgagttacggaacccgtacggaaaccgagtacgggtacgtccgggtacgggggacccgg

SEQ ID NO: 364490 - DNA, 549 bp, Homo sapiens
  misc_feature: GZ8MTXP02F4B7C.52.28.C06.1.454.CMB.2.raw
  modified_base (420)..(420): a, c, t, g, unknown or other
  modified_base (539)..(539): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttctggataccccataaccggctactacttacactgggtgcgacaggcccctggacaagggcttgagtggagtggggtgaacatcccaagagtggagcaccggtcgcacagaatatgcgcggtaagttcaggggcaggggtcaccatcgacagcgaacaggtcccaactaanacgacacctacagtggaagctaaagtagactgaacatccgtagacaacgcggccgtatatttagtgtgtagagaagaccggaccagtacgaaccctacggaactaggtcggacgttcgnggggacccgg

SEQ ID NO: 364491 - DNA, 600 bp, Homo sapiens
  misc_feature: GZ8MTXP02GBZQH.52.28.C06.1.454.CMB.2.raw
  modified_base (371)..(371): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacactgggtgcgacaggcccctggacaagggcttgagtggagtggggtaggaacaatcccaacgaggtggaggcaccggtccgcacagaatangcgcggtaagttcgagggcgagggtcaccgatcgaccgagcgacgaggtcccaactaaccacacgaccctaacagtagggaagtacgtaaaggtagaccttaggaaccatccgtagaaccgtaaccgacgggtcccgtacttaagtttagttggtagtaggaaggacggaacggaacccgagtaccggaacctacggaactagtacggacgttcggacgggggacccgg

SEQ ID NO: 364492 - DNA, 565 bp, Homo sapiens
  misc_feature: GZ8MTXP02H0IDH.52.28.C06.1.454.CMB.2.raw
  modified_base (226)..(226): a, c, t, g, unknown or other
  modified_base (405)..(405): a, c, t, g, unknown or other
  modified_base (439)..(439): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctcctgtaaggcttctggactaccccataaccggctactacttacactgggtgcgacacggcccctggacaagggcttgagtggagtggggtaggaacatacccaaacgagtaggaggcgacggtccggacacagaatagtgcgcgaaagtttcagggcagggcaccagnaccagacgacaggtcccaataacacacgacctanagagagactaagtagactagacatacgacgacgacgacggtaccgtactaattagtagtgtagtaaggacgacggaccgtagacgtaaccgtacgaacgacgtacggtacgtacggtacgggaccg

SEQ ID NO: 364493 - DNA, 569 bp, Homo sapiens
  misc_feature: GZ8MTXP02F6P6B.52.28.C06.1.454.CMB.2.raw
  modified_base (338)..(338): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactactacactgggtgcgacaggcccctggacaagggcttggagtggatggggtgaacaatcccaanagtggaggcaccgggtccgacacagaactatgcgcggtaagtttcgaggggcgaggggtacaccatacgaccagacgacgacgggtcccactaaaccacacgacctacagtaggagactaaagtagacctagactatcgtagacgacacggccgtactattagttgtagtgagagacggacccgagtcgaaccgtacgaaacgtacgtggacgttcgcggggtaacccggg

SEQ ID NO: 364494 - DNA, 572 bp, Homo sapiens
  misc_feature: GZ8MTXP02IGGNA.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctggggactgaggtaaagagaccaggggcctcagtgaaggtctcctgtaaggcttctggataccccataaccggctactacttacactgggtgcgacaggcccctggacaagggcttgagtggatggggtggaacaatccaacagtgaggcacggtcgacacagaatatgcgcggtaagtttcgaggggcaggggtcacgatcgacagcgacgaggtccaactaacacacgacctacataggaagactaaaggtagacctagaacattcgacgacgaacaccggccgtactaactttaattgtgtacgagagacgggaacccgatcggaacctccggaaaactacgttagggaaccgtttcggacgggggacccgg

SEQ ID NO: 364495 - DNA, 594 bp, Homo sapiens
  misc_feature: GZ8MTXP02G3OSG.52.28.C06.1.454.CMB.2.raw
  modified_base (250)..(250): a, c, t, g, unknown or other
  modified_base (287)..(287): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctctgtaaggcttnggactacccataaccggctactacttacacctgggtncgacacggcccctggacaagggcttggagtggagtggggtaggaacaacgtcccaagaggtggaggcgaccggtccgacacgagaatatgacgcggtaaagtttcgagggtcagggtcacagtcgaccagcgacgaggtcccaacaacgacacgacctacataggacgtacgtaagtacgactagaacagtacgtacgaaccgaacgaccgggtaccgtactaagtttacgttggtagtgaagaacggacggaacccgagtacgaaccgtaccgaaagcgtacggaccgttcggcggggaacccggg

SEQ ID NO: 364496 - DNA, 589 bp, Homo sapiens
  misc_feature: GZ8MTXP02IL5O3.52.28.C06.1.454.CMB.2.raw
  modified_base (289)..(289): a, c, t, g, unknown or other
  modified_base (356)..(356): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctggggactgaggtaaagagaccaggggcctcagtgaaggtctcctgtaaggcttctggactacccataaccggctaactacttacactgggtncgacaggcccctggacaaggcttgagtggagtggggtaggaacaatcccaacagtgagcaccggtcncacagaatatgcgcgggaagtttcgagggggtacaggggtcaccagtcgaccagcgacaggtccaactaacacagacctacgatggagactaaagacgagtgaacagttcagaacgacgaccggaccgtactatttaacttggtgtacggaagaacggacgggaaacccgtagtaccgtaacccgtaacgaaaaccgtgttacgggaaccgtttacggcgggggtacccgggg

SEQ ID NO: 364497 - DNA, 561 bp, Homo sapiens
  misc_feature: GZ8MTXP02G4P0Q.52.28.C06.1.454.CMB.2.raw
  modified_base (287)..(287): a, c, t, g, unknown or other
  modified_base (398)..(398): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttctggactaccccataaccggctactacttacactgggtncgacaggcccctggacaagggcttgagtggagtggggtggaacaatcccaagaggtggaggcgaccggtcgcacagaatagtgcgcgggtaagtttcgaggggcaggggtnacatgaccagcgacgacggtaccactaacacagccctacagtaggagacgtaaagtagactgaacatcgtagacgacgaccggtccgtactaattagttgtgtagagacggacgaaccaatcgaaccgtacgaaactgtacggacgtcggtacggggacccgg

SEQ ID NO: 364498 - DNA, 566 bp, Homo sapiens
  misc_feature: GZ8MTXP02IJ422.52.28.C06.1.454.CMB.2.raw
  modified_base (446)..(446): a, c, t, g, unknown or other
  modified_base (462)..(462): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttctggtggcagcagccacaggagcccactcccctggagcgtctggtacaatctggggactgaggtaaagagaccaggggcctcagtgaaggtctcctgtaaggcttctggactaccccataaccggctactacttacactgggtgcgacaggcccctggacaagggcttgagtggagtggggtggaacaatcccaacagtggaggcaccggtccgacacagaatatgcgcgggtaagtttcgagggggcagggggtcaccagtgaccagcgacgaggtaccaataacacacgccacatgganactaagtagatgaacntctagacgacacggcctatatttattagtgtagagagacggaacccgtatacggaaccttaccgaaaacgtagtacgggtaacggttcggtcgggggaacccgg

SEQ ID NO: 364499 - DNA, 533 bp, Homo sapiens
  misc_feature: GZ8MTXP02IABRU.52.28.C06.1.454.CMB.2.raw
  modified_base (227)..(227): a, c, t, g, unknown or other
  modified_base (454)..(454): a, c, t, g, unknown or other
  modified_base (465)..(465): a, c, t, g, unknown or other
  modified_base (506)..(506): a, c, t, g, unknown or other
  modified_base (520)..(520): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctnagtgaaggtctcctgtaaggcttctggataccccataaccggctactacttacactgggtgcgacaggcccctggacaaagggcttgagtggagtggggtaggaacaatcccaaacagtggagcaccggtcgcacagaaatatgcgcggggaaagtttcaaggggcaggggtcaccgatgaccagcgacaggtccactaaacacagccacagtggagctaaaggtanactgaactatntgacgacgacgacgtactattattgtgtgagagacgacganagaacgacgaacanagacgtcgcggcg

SEQ ID NO: 364500 - DNA, 689 bp, Homo sapiens
  misc_feature: GZ8MTXP02GYF4Y.52.28.C06.1.454.CMB.2.raw
  modified_base (335)..(335): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttctggactacccataaccggctactacttacactgggtgcgacaggcccctggacaaggcttgagtggagtggggtgaacatcccaanagtggagcaccggtcgcacagaatatgcgcggaagtttcgaggggtcaggggtcaccagtacgaccgagacgacgacgggtcccaactaaccacgacgacctaaaccgagtagggacgtaaccgtaaggtaacgaacgttacggaacaatttaccgtaggtaaccggaaccgaaccggggtaccccgggtttaccttaacgtttttaaaacgtttggttaggtttacgggtaaagggtaaacgggtaccggggaaaacccccggtagtaaaccggtaaccccggttaacggaaaaccgtaaacggtacggggtaacccgggtttaaccgggtccggggggtaaacccccggggg

SEQ ID NO: 364501 - DNA, 526 bp, Homo sapiens
  misc_feature: GZ8MTXP02FMPQ4.52.28.C06.1.454.CMB.2.raw
  modified_base (368)..(368): a, c, t, g, unknown or other
  modified_base (490)..(490): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactacttacactgggtgcgacaggcccctggacaaggcttgagtggagtggggtggaacaatcccaacagtggaggcaccggtcgcacagatatgcgngaagttcgagggcagggtcacatgaccagcgacaggtcccaactaacacagcctacatggagactaagtagactagacatctagacgacgacggcgtctattatgtgtgagagacggacccntacgaacctcgaaacagtggacgtcgcggggaccgg

SEQ ID NO: 364502 - DNA, 632 bp, Homo sapiens
  misc_feature: GZ8MTXP02IV0PW.52.28.C06.1.454.CMB.2.raw
  modified_base (480)..(480): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctggactgaggtaaagagaccgagggcctcagtgaaggtctcctgtaaggcttcgtggactaaccccataaccggctactacttacacgtgggtgcgacacggcccctggacaagggcttgaggtggagtggggtaggaacaacgtccccaaagaggtggaggaccgaccggtccgcaacgaaggaaatagtcggcgcggggtaagtttacggacggggtacgacggggtacacctagacgaccaacggcgaacgacggtacccaaactaacaacacgacctaanagtacggagactaaagtacgactaggaacctagtcctaggacgacgaccggccgtactagttacttagtggtacgaaggtacggaacggtaccccgagttacgaacccgttcgaaacacggttacggaccggtacggtcgggggaacccggg

SEQ ID NO: 364503 - DNA, 711 bp, Homo sapiens
  misc_feature: GZ8MTXP02GYSUK.52.28.C06.1.454.CMB.2.raw
  modified_base (290)..(290): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctgaggtgaaggtctccgtgtaaggcttctggactacccataaccggctactacttacactgggtncgacacggcccctggacaggcttgagtgagtgggtaggacaactccgaacgtagtggacggcgaccggtccgacgacgaggaaatagtggcggtaccgggtaagtttcggaggggtcctaacgggggtaccaacccgagtacgaacccgacggaccgaacgtacggggtaccctaaaccgtaaaccgaccaaacgaccccttaagacgttagggacgtacgtaacggtaacgtaccgtgaaacgtataccgtacggtaaccgaccggtaacccggtccgggttaacttaacgttttaacgttaggttggtaacggttaaaggtaacggtaaccgggggaaccccctaaggtaccggtaacccgacgtaaaaccgttacggtacgggtaaccggtttaccggtccgggggtaaaccccgggg

SEQ ID NO: 364504 - DNA, 704 bp, Homo sapiens
  misc_feature: GZ8MTXP02GWQ55.52.28.C06.1.454.CMB.2.raw
  modified_base (649)..(649): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactggaaggtaaagagaccgaggggcctgagtgaaggtctcgtagtaaggcttcgtggactacccataccggctactactacacgtgggtcgacgacgacggcccctggaacgaaggtctaggacggtggaggtggggtaggaaactaacgtcccgaaacgtaggtacggaacggccgtaaccggcccgaccgaaccgaagaaacttagtacggacggtaccggggtaaagtttcggaacgggggaccgagggggttaccaaaccgtaacgtacgaacccgaacggaccgaaacggaaccggttaacccaaacgtaaaccaacgacgtaccccttaaagagtagggataaccgtaaagtaacgacttagaacctacgttacgacggaacgaccgaccgggtccgttacttaatttacgtaggtgtaggaaacgacggacggacccgtanaccggtaaccgtaccgaaaacgtgtacgggaaccgttcgggacggggtaacccgg

SEQ ID NO: 364505 - DNA, 565 bp, Homo sapiens
  misc_feature: GZ8MTXP02FWEPE.52.28.C06.1.454.CMB.2.raw
  modified_base (251)..(251): a, c, t, g, unknown or other
  modified_base (444)..(444): a, c, t, g, unknown or other
  modified_base (464)..(464): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcnggactaccccataaccggctactacttacactgggtgcgacacggcccctggacaagggcttgagtggagtggggtgaacaatacccaagaggtggaggccaccggtccgacacagaatatgcgcggaagtttcgagggtcagggtcacatgaccagcgacacggtaccactaacacacgacctacatagganacgtaagtagactagactanctagacgacgcggaccgtatattagtggtagttgaaggaggacggaacccgtagtcggaacctacggaactacggtcggacgtcgggtacggggacccggg

SEQ ID NO: 364506 - DNA, 588 bp, Homo sapiens
  misc_feature: GZ8MTXP02FPXA7.52.28.C06.1.454.CMB.2.raw
  modified_base (466)..(466): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataacccggctactacttacacgtgggtgcgacaggcccctggacaaggcttgagtggatggggtgaacaatcccaagagtgggaggcaccggtccgacacaagaactagtgcgcgggtaaagtttcgaggggtcaggggtacaccgtagtaaacgaccaggcgaacgacggtcccaaactaacacacgccctaacagtaggaanactaaaggtagacctaggactatcgtagacgacgaccggtctactattacgtgtagtagaaggacgacggacccgagtacgaaccgtacgaactagacggtaaccgtcggtacgggacccgg

SEQ ID NO: 364507 - DNA, 535 bp, Homo sapiens
  misc_feature: GZ8MTXP02J2RTX.52.28.C06.1.454.CMB.2.raw
  modified_base (183)..(183): a, c, t, g, unknown or other
  modified_base (363)..(363): a, c, t, g, unknown or other
  modified_base (459)..(459): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggancgtctggtacaatctgggactgaggtaaagagaccaggggcctcagtgaaggtctcctgtaaggcttctggactaccccataccggctactacttacactgggtgcgacaggccccctggacaagggcttgagtgggatggggtagacaatcccaacagtggaggcaccggtccgcacanaatatgcgcgggaaagtttcaggggcaggggtcaccatgacagcgacaggtcccacgtaacacacgcctacatggagactaagtagactgacatcngacacgacgccgtctaattattgtgtgagagacggcccgatcgaacctcgaacagtggacgtctcgggggacccgg

SEQ ID NO: 364508 - DNA, 621 bp, Homo sapiens
  misc_feature: GZ8MTXP02IYFE7.52.28.C06.1.454.CMB.2.raw
  modified_base (227)..(227): a, c, t, g, unknown or other
  modified_base (251)..(251): a, c, t, g, unknown or other
  modified_base (293)..(293): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctnagtgaaggtctcctgtaaggcttnggactaccccataaccggctactacttacacgtggtgcgacncggcccctggacaagggtcttgaggtggagtggggtaggaacaacgtacccaacgaggtgggacggcgaccggtccgacgaccgagaactagtcggacgcgggtaagtttcgaggggcgagggtacaccgatcgaccgagcgaacgacggacccaactaacacgacgacctacagtagggatacgtaagtagactagactagtcgtagaccgacgaccggtaccgtacttaagtttagttggttaggtacgagggaacgtacggaaacccgtaagtaccgaaccgtacgaaacgtacgtacgggacgtcggtcgggggaaccccgggg

SEQ ID NO: 364509 - DNA, 628 bp, Homo sapiens
  misc_feature: GZ8MTXP02JOZ7K.52.28.C06.1.454.CMB.2.raw
  modified_base (227)..(227): a, c, t, g, unknown or other
  modified_base (250)..(250): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaggtaaagagaccaggggcctnagtgaaggtctcctgtagcttcnggactacccataccggctactacttacacgtggtgcgacacggcccctggacaagggcttggaggtggagtggggtagaacaactacccgaaagaggtaggacggcgaccggtccgccgaacgagaaatagtaggccggtacgggtaaagtttcggacggggacgacggggtccaaccgagtacgaccgagaccgacgacggtacccaacgtaaccacgacgacctaacagttaggaagaccgtaaagtagacgtagaactagtacgtagaccgaccaccgggtccgtacttaagtttacgttggtgaggtagacggacggacccgagtaccgaaccgtacgaacgtacgtacggtaccgtacggtacggggacccgg

SEQ ID NO: 364510 - DNA, 674 bp, Homo sapiens
  misc_feature: GZ8MTXP02HFHWD.52.28.C06.1.454.CMB.2.raw
  modified_base (252)..(252): a, c, t, g, unknown or other
  modified_base (345)..(345): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctgagtgaaggtctcctgtaaggcttcnggactaccccataaccggctactacttacacgtgggtgcgacgacggcccctaggacaagggcttgagtggagtggggtagaacatcccgaanaggtggaggcgaccggtccgacacaaggaatagtcggacgcggggtaaacgtttacgagggggacaggggtccaaccgagtcgaaccgaggaccgacgtacggtacccaactaaaccgacgaacgaccctaacgagtacggacgtaccttaaaggtacgaccgttaggaacctagtaccgtacggaaccgtaacggacccggggtacctttacgtaactttacgttggtagttacggaggtaacgggaccgggtaaccccgagtttaccggaacccgttaacggaaacctaggttacggaaccggtttccgggacgggggtacccccgg

SEQ ID NO: 364511 - DNA, 689 bp, Homo sapiens
  misc_feature: GZ8MTXP02IUJHK.52.28.C06.1.454.CMB.2.raw
  modified_base (252)..(252): a, c, t, g, unknown or other
  modified_base (289)..(289): a, c, t, g, unknown or other
  modified_base (381)..(381): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttcnggactaccccataaccggctactacttacactgggtncgacacggcccctggacaaggtcttgagtggagtggggtaggaacaacgtcccaaagaggtggaggccgaccggtcgcacgagaatatgcgnggtaagtttcgaggggcaggggtcaacgatacgaccgagacgacgacggtacccaacgtaaccacgacgacctacgagtacggacgtaaccgtaaaggttacgaacgttacggaactaacttaccgtaacgaaccggaaaccgacccggggtacccgttaacctttaaacgttttaaacgtttcggttacggttaacgggtaaagggtaacgggaaaccgggaacccccgtaagtaccgtaaaccccgttacggaaaacgtacggttaacgggacccggtttacgggttaccgggggaaaccccgggg

SEQ ID NO: 364512 - DNA, 535 bp, Homo sapiens
  misc_feature: GZ8MTXP02FRMEX.52.28.C06.1.454.CMB.2.raw
  modified_base (226)..(226): a, c, t, g, unknown or other
  modified_base (429)..(429): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctctgtaggcttctggatacccataaccggctactactacactggtgcgacaggcccctggacaagggcttgagtggagtggggtggaacatcccaacagtggaggcacggtcgcacagactatgcgcggaagtttcgagggtcgagggtcaccatgaccagcgacaggtccactaacacacgcctacatgganctaagtagactagacatctagacgacgacggtccgtactagttattggtagtgagacgacggacccgatcgaaccgtcgaacagtacggacgtcgtaggggaccgg

SEQ ID NO: 364513 - DNA, 663 bp, Homo sapiens
  misc_feature: GZ8MTXP02HW9XM.52.28.C06.1.454.CMB.2.raw
  modified_base (295)..(295): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggaccggacctggaggatcctcttcttggtggcagcagccacaggagcccactccctggagcgtctggtacaatcgtgggactgaaggtaaagagaccgaggggcctcagtgaaggcctccgtagtaaggcttcgtggactaccccataacccggctactacttacactgggtncgacacggccccctggaacgagggtctaggagtaggagtggggtaggaaacaacgtccccaaagtaggtgggacggtccgaccgggtcgaccaacgaagaatatggccggaggtaagtttccgaaggggcaggggtaccaccgatacggacccaggaccgaacgtacgggtacccaacctaaacgaccgaacgacctaacacgtacggagtaccgtaaagttaacggaccttagaacagttacgacgaacggaacgtaccgggtcccgttatatttaagttcgtagtgagacggacgggacccgagtaccgaccgtaacgaaacgtaacgtcgggtaaccggttcggtaccgggggacgacccggggg

SEQ ID NO: 364514 - DNA, 661 bp, Homo sapiens
  misc_feature: GZ8MTXP02FRYSF.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcgagtgaaggtctcctgtaaggcttctggactaccccataaccggctactactacacgtgggtgcgacacggcccctggacgaagggcttggaggtggagtggggtagaacaactcccaagaggtagggacggccgaccggtccgaccaacgaaggaactagtcggccggacggggtaaacgtttcgaagggggtccgaacgggggttaccaaacccgagttacgaacccgaggaccgaacgacgggtaccccaaacgtaaaccacgaacggtaccctaaacgagttacgggaacgtacgttaaaaggtacgaccttagaacctactacgtacggaaccggaaccgaccggtaccgtacttaagtttacgttgtgtagaggacgacgacccgataccgaaccgtacgaactagtacggcgtacggcggggacccgg

SEQ ID NO: 364515 - DNA, 611 bp, Homo sapiens
  misc_feature: GZ8MTXP02H4UGP.52.28.C06.1.454.CMB.2.raw
  modified_base (340)..(340): a, c, t, g, unknown or other
  modified_base (462)..(462): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaggtctcctgtaaggcttctggactaccccataacccggctactacttacactgggtgcgacacggcccctggacaagggcttgagtggagtggggtagaacatccaanaggtggaggcgacggtcgacacagaatatggacgcgggaaagtttcgaggggtcaggggtcaccagtcgacgagcgacgacggcaactaacgacacgacctacagtggatacgtaaaggtanaaccgtaggactaatctacggaacgaacgaccgggccgttacttaaacgtttacttagggttggttaggaaggaagggtaccggaacccggtagttacggaacccgtacggaaactacggtcggtaacggtcggtcgggggaacccggg

SEQ ID NO: 364516 - DNA, 559 bp, Homo sapiens
  misc_feature: GZ8MTXP02HJRGX.52.28.C06.1.454.CMB.2.raw
  modified_base (339)..(339): a, c, t, g, unknown or other
  modified_base (356)..(356): a, c, t, g, unknown or other
  modified_base (361)..(361): a, c, t, g, unknown or other
  modified_base (365)..(365): a, c, t, g, unknown or other
  modified_base (388)..(388): a, c, t, g, unknown or other
  modified_base (537)..(537): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacatctgggactgaggtaaagagaccgaggggcctcgagtgaaggtctcctgtaaggcttctggactacccataaccggctactacttacactgggtgcgacacggcccctaggacaaggcttggagtggagtgggagaacatcccaangtgagcacggcacacanatagngcgngtagtcgaggcgacggtcacganacgacgagcgacgacgtaccaactaacacgacgacctagagtacggactacgtaagtacgacgtacgaactacgtcgtacgaccgacgacgtctacgttattacgtgtagtacgagacgacggacgtagacgaaccgtacgaactacgnggtaccggtcggtacgggaccg

SEQ ID NO: 364517 - DNA, 642 bp, Homo sapiens
  misc_feature: GZ8MTXP02GN6ZZ.52.28.C06.1.454.CMB.2.raw
  modified_base (489)..(489): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctgggactgaggtaaagagaccgaggggcctcagtagaaggtctccgtggtaaggtcttcgtggactaccccaataaccggctactacttacactgggtgcgacacggcccctaggacaagggcttggaggtggagtgggggtagaaacaacgtccccaaacgaggtagggacggaccgtaaccggtccggacacgaagaacgtagtcggcgacgggtaaagtttcgaggggtcgaacggggtcaccgagtacgaccgagcgaacgacggtacaacgtaacacaacgccctanagtaggagactaaacggtagactagacattacgacgacgaacgtccggacccgttgttaactttacgtggtgtacggtagacggaccggaaccctaagtaccggaaccttacggaaactacggtacggaaccgttcggcgggggtaacccggg

SEQ ID NO: 364518 - DNA, 616 bp, Homo sapiens
  misc_feature: GZ8MTXP02JQ3VB.52.28.C06.1.454.CMB.2.raw
  modified_base (343)..(343): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaaggcttctggactaccccataacccggctactacttacactgggtgcgacacggcccctggacgaaggcttgagtggagtggggagaacaagtcccaanagtggagcaccggtcgcagagaatagtgcgcggtaagtttcgagggcgagggtcacgagtcgaccaggacgaacgacggtacccaactaaacaacgacgaccctaacgagttaggaacgtacgtaaagtaagacttacggaactagttacgacggaaccgacgaccgggtaccctattaatttacgttggtagttaggaacgacggaaccggtaacctaagtcgtaaccgacgaaacgtacggtacggaccggttcggacggggtaacccggg

SEQ ID NO: 364519 - DNA, 598 bp, Homo sapiens
  misc_feature: GZ8MTXP02JKX7E.52.28.C06.1.454.CMB.2.raw
  modified_base (251)..(251): a, c, t, g, unknown or other
  modified_base (342)..(342): a, c, t, g, unknown or other
  modified_base (368)..(368): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcnggactaccccataaccggctactacttacactgggtgcgacacggcccctggacgaaggcttgagtggagtggggtagaacaatccgaaanggtggaggcaccggtcgcacagaatntgacgcgggaagtttcgagggcaggggtcacgagtcgacccagaccgacacggtcccaaacgtacaacgacgacctacagttggactacgtaaaggtacgactggaaccagttccgaacggacgaaccacgggtccctagtaatttacgttgtaggtcggaacgtaacggacggaaccccgagttcgaacccgttacgaacgtagcggtacgttcggacggggtacccgg

SEQ ID NO: 364520 - DNA, 606 bp, Homo sapiens
  misc_feature: GZ8MTXP02I311B.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcgagtgaaggtctccgtgtaaggcttctggactaccccataaccggctactacttacactgggtgcgacaggcccctggacaagggcttgagtggagtggggtaggaacaacgtcccaacgagtgggaggccgaccggtccgctacagaactagtgacggcgggtaaagtttcgagggccaggggtcaccatcgaccagcgacgaggtcccaacgtaaccacgtacgcctaacagttacggagtacgtaaagtagacttaggactataccgtagaccgaacgccggaccgtacttaacgtttattggttagtggtaaaggagacggaacccgtagtcgaaccgttcggaaacacggtacggacgtcggtacggggacccgg

SEQ ID NO: 364521 - DNA, 594 bp, Homo sapiens
  misc_feature: GZ8MTXP02ILGFW.52.28.C06.1.454.CMB.2.raw
  modified_base (251)..(251): a, c, t, g, unknown or other
  modified_base (408)..(408): a, c, t, g, unknown or other
tcagcgcagtacgacacgaccggtgctcgatttagagctcacgtattgggttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctcagtgaaggtctcctgtaaggcttcnggactacccataaccggctactactacacgtgggtgcgacacggcccctggacgaagggcttggagtggagtggggtaggaacatcccaacaggtggaggcaccggtccgacacagaatgtcgcgcgggtaagtttcgaggggacaggggtcaaccntacgacgacgcgacgaggacccaacgtaacacacgacctacagtaggagacgtaagtagactagaacacgttcagacgaacgtaccggtccgtatacgtttacgtttaggtgtacggaggaacgacggaacccggattacgaaccgtacgaaacgtagtacgggaccgttcggtacggggacccgg

SEQ ID NO: 364522 - DNA, 597 bp, Homo sapiens
  misc_feature: GZ8MTXP02JBO3C.52.28.C06.1.454.CMB.2.raw
  modified_base (342)..(342): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcgagtgaaggtctcctgtaaggcttctggactaccccataaccggctactactacactgggtgcgacacggcccctggacaagggcttggagtggagtggggtgaacagtcccaanagtggaggcgaccggtcgacacagaatagtgcgcgggtaagtttcgagggcagggtcaccatgaccagcgacgaggtacccaactaaccacacgcctaacagtaggacgtacgtaagtagactagacagtctagacgacgacggtccgtacttaagttacgttggtagtacggaagacggtacggaaaccctaagtaccggtaaccgtacggaaaacacggttacgggaaccggttacggtacgggggacccggg

SEQ ID NO: 364523 - DNA, 725 bp, Homo sapiens
  misc_feature: GZ8MTXP02HNQI0.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctcagtgaaggtctcctgtaaggcttctggactaccccataaccggctactacttacactgggtgcgacacggcccctggacaagggcttgagtggatggggtggaacatcccaacagtggaggcaccggtcgacacagaatatggcgcggggtaagtttcgaggggtcaagggggtcaaccgagtcgaaccacggaccgaacgacgggttacccacgtaaaccacgaacgccctacacgttagggaacgtccgttaaaaggttacgacttacgggaacctagttaccgtaggaaccgacccggtaacccggggtacccggttaccttaaacgttttaacgtttacggtggtttacggggtaaagggtaaacgggtaaaccgggggaaccccccggtaaggttaccgggtaaacccccgttaaccgggaaaacccgtaacgggttaccgggggtaaaccccgggtttaccggggtttccgggggggtaaaccccccggggg

SEQ ID NO: 364524 - DNA, 534 bp, Homo sapiens
  misc_feature: GZ8MTXP02I1VO9.52.28.C06.1.454.CMB.2.raw
  modified_base (371)..(371): a, c, t, g, unknown or other
  modified_base (498)..(498): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctcagtgaaggtctcctgtaaggcttctggataccccataaccggctactacttacactgggtgcgacaggccccctggacaagggcttgagtggatggggtggaacaatcccaacagtggaggcaccggtcgcacagaatatgcgngggaagtttcgaggggcaaggggtcaccatcgacagcgacaggtccaactacacacgcctacatggagctaagtagactgaccatctgacgacacggcgtactattattgtgtgagagacggaccgntcgaacgtcgaacacgtcggacgtcgtcgggaccgg

SEQ ID NO: 364525 - DNA, 584 bp, Homo sapiens
  misc_feature: GZ8MTXP02IELDL.52.28.C06.1.454.CMB.2.raw
tcagcgcagtacgacacgaccggtgctcgatttagagctcacgtattgggtttgggggagcatcacccagcaaccacatctgtcctctagagaatcccccagagagctccgttcctcaccatggactggacctggaggatcctcttcttggtggcagcagccacaggagcccactcccctggagcgtctggtacaatctggggactgaggtaaagagaccgaggggcctcagtgaaggtctcctgtaaggcttctggactaccccataaccggctactacttacactgggtgcgacacggcccctggacgaagggcttgaggtggagtggggtaggaacaagtcccaaacgagtagggaggcaccggtccgacacgagaatatggacgcgggtaagtttcgaggggcgaggggtacaccatcgacagcgacacggtccaaactaacacacgacctacagtacgggaagtacctaaaggttagacctagaactgtactgaacgacgacggccgtatattaatgtgtgaggagtacggacccgatacgaaccgtacgaatagtacggacgttcggcggggacccgg

SEQ ID NO: 364526 - DNA, 621 bp, Homo sapiens
  misc_feature: GZ8MTXP02HXUXI.52.28.C06.1.454.CMB.2.raw
  modified_base (342)..(342): a, c, t, g, unknown or other
  modified_base (496)..(496): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctcagtgaaggtctcctgtaaggcttctggactaccccataacccggctactacttacactgggtgcgacacggcccctggacaagggcttgagtggagtggggtgaacactcccaanagtggacgcgaccggtccgacacaggaactatcggcgcgggtaagtttcgaggggcgagggggtccaaccgatcgaccaggaccgacgacggtcccaaacttaaccacacgaccctacgagtaggagtacctaaaggtacgactagactagtcncgaaccgacgaccggtccgtacttaacgttagttgttggtacggaaggaaggaccgggacccgtatacgggtaaccctacggaaactaacggtcgggaaccgtttcgggacgggggaccccgggg

SEQ ID NO: 364527 - DNA, 681 bp, Homo sapiens
  misc_feature: GZ8MTXP02HTCOM.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtcctcgtagtaacggtcttcgtggaacctaccccaagtaacccggctactacttacacgtgggtgcgacacggcccgtggacgaggtcttgaggtggaggtggggtacgaaacactacccgaagaggtcgggacggaccgaccggtccgacgaacgaagtaaacttagtcgggacggtacggggttaaacggtttcggaagggggtccgtaacgggggtacccaaacgtacgacgaaacccgacggacgaaaccggacgggttaacccaaacgtaaaacccgacgaaccgtacccttaacgagttaacggacgttaacgttaaaggttacgacgtaggaacctagtccgaggaaccgacgtaccggtcctattattagttcggttgagacggagaccgacctaaagcaacgtacgaagtcgtacggtacgtcggtcggggacccgg

SEQ ID NO: 364528 - DNA, 539 bp, Homo sapiens
  misc_feature: GZ8MTXP02HWZ2Q.52.28.C06.1.454.CMB.2.raw
  modified_base (213)..(213): a, c, t, g, unknown or other
  modified_base (227)..(227): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagngaccgaggggcctnagtgaaggtctcctgtaaggcttctggactaccccataaccggctactacttacactgggtgcgacacggcccctggacaagggcttgagtggagtggggtggaacaatcccaacgagtggagcgacggtcgcacagatatgcgcgaagttcgaggcgaggtcacatgaccagcgacgaggtacccacgtaacacacgacctacgatggacgtactaagtagactagacatcagacgacgacggctactattatgtgagtagacgacgacccaagtcgaaccgtcgaacacgaggacgtcggtcgggaccgg

SEQ ID NO: 364529 - DNA, 597 bp, Homo sapiens
  misc_feature: GZ8MTXP02FILR1.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctctgtaaggcttctggactaccccataaccggctactactacactgggtgcgacacggcccctggacaagggctgaggtggagtggggtggaaacaacgtcccaaacgaggtgggaggccgaccggtccgcaacagaatagtgcgtcggaagtttcgaggggccaggggtcaaccatacgaccagacgacgaggtacccactaaccacgtaacgcctaacgatagggaacgacgtaaagtaaggactaggactactcgtacgaccgacgaccggccgtactagttagttgtagtagagacggacggacccgagttcgaaccgtacgaacgtacgtcggtacggtcggcggggaacccggg

SEQ ID NO: 364530 - DNA, 556 bp, Homo sapiens
  misc_feature: GZ8MTXP02I5XAP.52.28.C06.1.454.CMB.2.raw
  modified_base (291)..(291): a, c, t, g, unknown or other
  modified_base (451)..(451): a, c, t, g, unknown or other
  modified_base (517)..(517): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcgagtgaaggtctcctgtaaggcttctggactaccccaatacccggctactacttacacgtgggtncgacacggcccctggacaaggcttgagtggagtggggtagaacaactcccgaacgaggtggacggcgaccggtccgcacgagaatagtgcgcggtagtttcgagggcagggtcacatacgacagcgacacggtaccaactacacacgcctacagtagganacgtaagacgactagacatcgagacgacgacggtcgtatagttatgtgtaggagacgacggaccgntacgaacgacgaacaggtacgacggtcggtacgggaccg

SEQ ID NO: 364531 - DNA, 521 bp, Homo sapiens
  misc_feature: GZ8MTXP02FFZR7.52.28.C06.1.454.CMB.2.raw
  modified_base (360)..(360): a, c, t, g, unknown or other
  modified_base (421)..(421): a, c, t, g, unknown or other
  modified_base (435)..(435): a, c, t, g, unknown or other
  modified_base (441)..(441): a, c, t, g, unknown or other
  modified_base (452)..(452): a, c, t, g, unknown or other
  modified_base (472)..(472): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggataccccataaccggctactactacactgggtgcgacacggcccctggaccaagggcttgagtggatggggtgaacaagtcccaaagaggtggaggcaccgggtccncacagaatatgcgcggaagttcagggcagggtcaccatgaccagcgacaggtccactaacncagcctacatgganctaagngactgacatcngacgcacggctctatattgngtgagagacggacccgatcgaacctgaacagtggacgtcgcggggaccg

SEQ ID NO: 364532 - DNA, 595 bp, Homo sapiens
  misc_feature: GZ8MTXP02IQCIZ.52.28.C06.1.454.CMB.2.raw
  modified_base (345)..(345): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgagggcctcagtgaaggtctcctgtaaggtcttctggactaccccataaccggctactacttacactgggtgcgacacggcccctggacgaagggcttgagtggagtggggtaggaacaatacccaanagtggaggcaccggtccgcacagaactagtggcgcgggtaagttttccgaggggacacgggggtcaaccgagtacgaccgacggcgaacgacgggttacccaactaaaccgacaacgaccctacagtaggacgtacgtaaagtagacctagaccatcgtagacgacgacggccgtctaatttattgtgtacgaggagacggacccgagtacgaaccgtacgaacacgttggacgttcggagggacccggg

SEQ ID NO: 364533 - DNA, 687 bp, Homo sapiens
  misc_feature: GZ8MTXP02GPSS2.52.28.C06.1.454.CMB.2.raw
  modified_base (229)..(229): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaaggtaaagagaccgaggggcctnagtgaaggtctcctgtaggcttctggactaccccataaccggctactacttacacgtgggtgcgacgacggcccctaggaccgaagggcttgaggtggagtgggggtaggaaacaacgtcccaacgaggtagggacggaccgtaccgggtcccgacgaaccgaagtaaaatacgtaggaccgggtaccggggtaaagggtttccggaagggggtaccgaagggggttacccaaaccgtacgtacgaacccgaaggccgaaacgacgggtacccaacctaaaccgacaacggtaccctaaacgagtacgggagtaccgtaaaagtacgactaggaactacttcgacgaaccgaccgaccggtaccgtacttaagtttagttggtagtagaggacggacggaaccccgagtaccgaaccgtacggaaactacggtaggaccgtcggtacgggggacccgg

SEQ ID NO: 364534 - DNA, 754 bp, Homo sapiens
  misc_feature: GZ8MTXP02FYJ1Z.52.28.C06.1.454.CMB.2.raw
  modified_base (294)..(294): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgccccactccctggagcgtctggtacaatctgggactgaggtaagagaccgaggggcctcagtgaaggtctcgtagtacggtcttcaggactacccacgtaccggactactacttacacgtgggtncgacgcggcccgtagacgaggtcttggaggtggtaggtggggtacggaactaacgtacccgaagacgggtaggacggaccgtaccggtccggacacgaagtaatacgtaggcgggtacgggtaacgtttacgggaaacggggtccgaacgggggttaccccaaaccgtacgtaaccggaacccggaaccggacccggtaaacgacccggggtaaacccttaaacctaaaccgaaacccgaacggttaccccttaaaacgaggttaaccggaaacggtacgttaaaacggttagacgtacggaactaaacgtccgtaaacggacccggtaaacggaccgggtacccgttattaactttaggtttcggtagtacggaaggacggaaaccgggaaccctaagttaccgaacccgttaacgaacgtacggttacgggaacgttccggggacgggggaacccggg

SEQ ID NO: 364535 - DNA, 678 bp, Homo sapiens
  misc_feature: GZ8MTXP02GTSFU.52.28.C06.1.454.CMB.2.raw
  modified_base (361)..(361): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactggaaggtaaagagaccgaggggcctcaggtgaaggtctcctaggtaaggcttcgtaggactaccccagtaacccggctactacttacacgtgggtgcgacgacggcccctaggacgaagggtcttggaggtggagtggggtagaacactcccgaanggtggagccgacggtccgacacgaagtaatagtcggcggtacgggtaaagttcggaacggggtacgaggggtccaaaccgtagtaccgaaccgaggaccgaacgtacggtacccaacgtaaccacgacggacctacgagtaggataacgtaaggtacgacgtagactaacgttcgacggaaccgtaaccgaccggttaccgtacttaatttacggttcggtagtaggaaacgggacgtaaccggtaaccccgaagttaccgaacccgtacgaaaccgtaggtaccggtaccggttacggtacgggggaaccccgggg

SEQ ID NO: 364536 - DNA, 729 bp, Homo sapiens
  misc_feature: GZ8MTXP02I1Z9Y.52.28.C06.1.454.CMB.2.raw
  modified_base (288)..(288): a, c, t, g, unknown or other
  modified_base (338)..(338): a, c, t, g, unknown or other
  modified_base (366)..(366): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttctggactaccccataaccggctactacttacactgggtncgacaggcccctggacaaggcttgagtggatggggtgaacaatcccaaanagtaggaggcaccggtccgcacagaatntgcgcggtaagttcgaggggcaggggtcaccgatcgaaccaggacgacgacggtcaactaacacacgaccctaacagtacgggaagtaccgttaaaagtacggtaacttacgggaaacctaacgtttaccgtaaggaacccgtaaaccggaccccgggggtaccccgtttaacctttaaaacgtttttaacggttttacggttacgggtttaacggggtaaaagggaaaccgggttaaaccgggggaaaaccccccggttaaggtttaacccggggaaaccccgtttaaccggggaaaacccttaagggttaccgggggaaccgggttttacccggggacgggggggttaaaccccccggggg

SEQ ID NO: 364537 - DNA, 640 bp, Homo sapiens
  misc_feature: GZ8MTXP02H9E7S.52.28.C06.1.454.CMB.2.raw
  modified_base (229)..(229): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactcccctggagcgtctggtacaatctgggactgaggtaaagagaccgaggggcctnagtgaaggtctcctgtaaggtcttctggactaccccataaccggctactacttacactgggtgcgacgacggcccctggacgaacgggctttggaggtgggagtgggggtaggaaacaaagtaccccaagacgtagggacggcgaccggtccgcacgagaatagtgcgcggaagtttcgagggcgagggtcaactatacgaccagcgacgacggcccaacgtaaacacgacgacctacgataggagacgtaaacgtagacgtagaactatacgtagacggaccgacggtaccgtacgttaatttacgttaggttggttaggaacggtaacggaacgggacccgtacgtacggtaaccgtacgaaacgtaacggttacgggtaacccgttcggtacgggggtaaccccgggg

SEQ ID NO: 364538 - DNA, 631 bp, Homo sapiens
  misc_feature: GZ8MTXP02F7JNN.52.28.C06.1.454.CMB.2.raw
  modified_base (291)..(291): a, c, t, g, unknown or other
  modified_base (494)..(494): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactggaaggtaaagagaccgaggggcctcagtgaaggtctcctagtaagcttctggactacccataaccggctactacttacactgggtnacgacacggcccctggacgaagggcttgagtggagtggggtgaaacaatcccaaagagtgggagccgaccggtccgacaacgaagaaatagtcgacgcgggtaaagtttcggaaggggccgaggggtacaccagtagaacccagacgtaacaggtacccaaactaacaacacgacctacagttacggaacgtactaaaggtanaacgtagaacaacgtgtacgaacggtaaccgaccggtccgttacgttaatttaacgttgtagttaggaaggaacggacggaacccgagtacgaacccgttacgaaactagtcggaacgttcggacggggaacccggg

SEQ ID NO: 364539 - DNA, 599 bp, Homo sapiens
  misc_feature: GZ8MTXP02HW5W7.52.28.C06.1.454.CMB.2.raw
  modified_base (226)..(226): a, c, t, g, unknown or other
  modified_base (249)..(249): a, c, t, g, unknown or other
  modified_base (342)..(342): a, c, t, g, unknown or other
  modified_base (421)..(421): a, c, t, g, unknown or other
tcagcgcagtacgacacgaccggtgctcgatttagagctcacgtattgggtttgggggagcatcacccagcaaccacatctgtcctctagagaatcccccagagagctccgttcctcaccatggactggacctggaggatcctcttcttggtggcagcagccacaggacgcccactccctggagcgtctggtacaatctggactgaaggtaaagagacgagggctnagtgaagtctctgtaaggcttcnggactacccataacccggctactacttacacgtgggtcgcgacacggcccctggacgaagggcttgagtggagtggggtagaacactaccaanaggtaggaggcgaccggtccgacacaagaatatggacggcggtaaacgtttcgacgggtacgacggggtaccaaccganacgaaccgaggacgaccgaacggtacccaaacgtaaaccaacaacgacctaacagtaggagacctaaagtacgacgtacgaacatacgacgaacgacgaccgggtcctactattagtgttgacgagacggacgaccgagtacgaaccgacgaacagtacggacgtcggacggaccggg

SEQ ID NO: 364540 - DNA, 666 bp, Homo sapiens
  misc_feature: GZ8MTXP02IMAML.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatcgtgggactgaaggtaaagagaccgaggggcctcagtgaaggtctcgtgtaaggcttctggactacccataaccggctactacttacacgtggtgacgacgacggccccgtaggacgaagggtcttggagtggagtggggtagaaacaagtacccgaagaggtcggaggccgaccggtccgacgaaccgagaactagtcggacggacgggtaaagtttcggaggggccgtacggggtaccaccgtagacgaccgagacgtaacgacggtacccaaactaaccgacaacgccctaacgagtaggactaacgtaaaggtagactaggaactacgtacgacggaacgaccggtaccggtaccgttagttaaatttggttaggtaggtaggaaacggacggtaaaccggacccgtaagtaccgaaccgttaacgaaacgtacggtacggtaccgtcgggtacggggacccgggg

SEQ ID NO: 364541 - DNA, 700 bp, Homo sapiens
  misc_feature: GZ8MTXP02FTDKO.52.28.C06.1.454.CMB.2.raw
  modified_base (213)..(213): a, c, t, g, unknown or other
  modified_base (250)..(250): a, c, t, g, unknown or other
  modified_base (335)..(335): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagngaccaggggcctcagtgaaggtctcctgtaaggcttnggataccccataaccggctactactacactggtgcgacaggcccctggacaaggcttgagtggatggggtggaacaatcccgaanaggtggaggcaccggtccgacgacagaactatggcgcggaaagtttcgaaggggcaggggtcaaccgatacgaccagcgaacacggtcccaacgtaacacgacgtacctaacagttacggaagacctttaaaaggtacgaaacgttcggaactaacgttcgtacggaaaccgaacgtaaaccccggggtccgttacctttaaagtttaacgttaggttgggttacgggaaaagggtaaccgggtaaaccgggggtaaaccccccaaggtttaccgggggaaaaccccttaacccggaaaaaccgtaaaggggtttcccgggggaaaaccgggtttccgggttaacgggggggtaaccccccgggg

SEQ ID NO: 364542 - DNA, 709 bp, Homo sapiens
  misc_feature: GZ8MTXP02HNOA6.52.28.C06.1.454.CMB.2.raw
  modified_base (225)..(225): a, c, t, g, unknown or other
  modified_base (244)..(244): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtggactgaggtaaagagacgagggcctnagtgagtctctgtagcttngactacccatacgctactactacactggtgcgacgacggcccctggacgaaggcttggagtggagtggggtaggaacaacgtcccaagaggtagggacggcgaccggtcccgacgacgagaagttatggacgcgggtaaagtttcgacggggtacgagggttaccaccgacgtacgaacccgagaccgaacgtacgggtaccctaaacgtaaaccacgaaccggtaccctaaacctagttacgggacgtacgttaaacggttaagaacccgttaggaaacctagttaccgacggaacccgttaaccggaacccgggtcccgtttaagttaacgttttaacgttcgggttaggttaacgggaaacggttaacgggaaaccggggtaccccgtaaggtttaccggaacccgttaacggaaacctacggtacgggtaaccggtcggggttaaccgggggaccccgggg

SEQ ID NO: 364543 - DNA, 676 bp, Homo sapiens
  misc_feature: GZ8MTXP02I2XH9.52.28.C06.1.454.CMB.2.raw
  modified_base (252)..(252): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccaggggcctcagtgaaggtctcctgtaaggcttcnggatatcccataaccggctaactacttacacgtggtcgcgacacggcccctggacaagggtctggagtggagtggggtagaacaactccgaaacgagtggaggccgacccggtcgacacagatactgcgcgtaagttcgagggctagggtccacgagtcgaacccgagaccgaacgtagggtacccaaccgtaaacacgtaaacgccctagaagtacgaagtaccttaaagtacgtaccgtagaccaagtttccgtaggaaaccgaccgtaacgggtcccggttacttaaaacgttttcgttaggttacgggtacggttaaacggtaagggtaaacccgaaccccgtaaaagttaacccggtaacccgtttaaacggaaaacccctgggttaccgggttaaccgggtccggtttaacccggggg

SEQ ID NO: 364544 - DNA, 544 bp, Homo sapiens
  misc_feature: GZ8MTXP02HZ0M4.52.28.C06.1.454.CMB.2.raw
  modified_base (182)..(182): a, c, t, g, unknown or other
  modified_base (323)..(323): a, c, t, g, unknown or other
  modified_base (334)..(334): a, c, t, g, unknown or other
  modified_base (359)..(359): a, c, t, g, unknown or other
  modified_base (363)..(363): a, c, t, g, unknown or other
  modified_base (386)..(386): a, c, t, g, unknown or other
  modified_base (395)..(395): a, c, t, g, unknown or other
  modified_base (409)..(409): a, c, t, g, unknown or other
  modified_base (418)..(418): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggancgtctggtacaatctgggactgaggtaaagagaccaggggcctcagtgaaggtctcctgtaaggcttctggactaccccataacccggctactacttacatgggtgcgacaggcccctggacaggcttgagtggatggggngaacatccaanagtgaggcacggtccgcacagatangcgnggagttcagggtcagggtcaccntgacagcanacggctaacaccanagaccctanataggagacgtaaagtagactacgactaactcacggacgacgaccggaccgtactatttaacgtgtagtgagagtacggaccattacgaaccttcggaaacactaggaccgtcggtacgggcccgg

SEQ ID NO: 364545 - DNA, 585 bp, Homo sapiens
  misc_feature: GZ8MTXP02GM6IV.52.28.C06.1.454.CMB.2.raw
  modified_base (290)..(290): a, c, t, g, unknown or other
  modified_base (411)..(411): a, c, t, g, unknown or other
  modified_base (465)..(465): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggtctcgagtgaaggtctcctgtaaggcttctggactaccccataaccggctactactacacgtgggtncgacacggcccctggacaaggcttgagtggagtggggagaacaactcccaagaggtaggagccaccggtccgcaacagaaatgtcgcgcgggtaatttcggaaggggcaggggtccaacgntacgaccagccgaacgacggtacccaacgtaaccacgacgcctaacagtagganaccgtaagtagactgaacatcacgacgacgacggtctactattacgttgtaggtgaggacgacggacccgagtacgaaccgtacgaaactcggtacgacggtttcggaccgggaccgggg

SEQ ID NO: 364546 - DNA, 538 bp, Homo sapiens
  misc_feature: GZ8MTXP02FYPK8.52.28.C06.1.454.CMB.2.raw
  modified_base (251)..(251): a, c, t, g, unknown or other
  modified_base (431)..(431): a, c, t, g, unknown or other
  modified_base (490)..(490): a, c, t, g, unknown or other
  modified_base (521)..(521): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcnggactaccccataaccggctactacttacactgggtgcgacaggcccctgacaaggcttgagtggatggggtgaacatccaacgagtggaggcaccggtcgcacagaatagtgcgcgggaagtttcgaggggtcaggggtcaccgatgacagcgacaggtcccaagtacacagccctaantaggagtacttaaagagactagaccagtctagacgacgaccggcgtactagttatggtntggagaggacgaccgatcggaactcggaaanacgtagacgtcgcggcg

SEQ ID NO: 364547 - DNA, 546 bp, Homo sapiens
  misc_feature: GZ8MTXP02I28UJ.52.28.C06.1.454.CMB.2.raw
  modified_base (286)..(286): a, c, t, g, unknown or other
  modified_base (335)..(335): a, c, t, g, unknown or other
  modified_base (358)..(358): a, c, t, g, unknown or other
  modified_base (426)..(426): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttctggataccccataaccggctactacttacactgggtncgacaggcccctggacaaggcttgagtgatggggtgaacaatcccgaanagtggagcacggtcgcacagaanatgcgcggaagtttcgagggcaggggtcacatgaccagcgacaggtcccaactaacacacgaccctanagtggaagtacctaaaggtagaccttggaaccattcagacgaacacggcgtactagtttactggtgtgagacggacgaccgatcgaaccgtacgaacagtcggactcggtacggggaccg

SEQ ID NO: 364548 - DNA, 663 bp, Homo sapiens
  misc_feature: GZ8MTXP02HID1R.52.28.C06.1.454.CMB.2.raw
  modified_base (253)..(253): a, c, t, g, unknown or other
tcagcgcagtacgacacgaccggtgctcgatttagagctcacgtattgggtttgggggagcatcacccagcaaccacatctgtcctctagagaatccccagagagctcccgttcctcaccatggactggacctggaggatcctcttcttggtggcagcagccacaggacgcccactccctggagcgtctggtacaatcgtgggactgaggtaaagagaccgagggcctcagtgaaggtctctaggtaagctcnggactacccagtaccgctacctacttacacgtggtcgcgacgacggcccctggacaagggtcttggaggtggaaggtggggtaacgaactaacgtaccccgaaagaggtagggacggccgtaccgggccccgaccaacgaagaaacgtagtcggacggtcgggtaaggtttcggaggggacgaaggggtccaacgtacgacgaaccgacggtacgaccgacggtaacccaacaaacccgacgaaccgacctaacgaggttacggacgtaaacgtaagtacgactacggaactagtcgtacgaacgaccggacgtcgtacttatttacgtagtagtacggagacggaccgtaccgacgtacgaacccgtacgtaaacgtagtacgggtaccgtcgggtacggggacccggg

SEQ ID NO: 364549 - DNA, 638 bp, Homo sapiens
  misc_feature: GZ8MTXP02FG70H.52.28.C06.1.454.CMB.2.raw
  modified_base (293)..(293): a, c, t, g, unknown or other
  modified_base (333)..(333): a, c, t, g, unknown or other
  modified_base (362)..(362): a, c, t, g, unknown or other
  modified_base (374)..(374): a, c, t, g, unknown or other
  modified_base (380)..(380): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggccctagagtggaaggtctccgtagtaaggcttgtggactaccccaataaccggctactactacacgtgggngcgactacggccccagacgaaggcttggagtgagtggggngaacatacccaagagtggagcctacggcncacagtaaatgngaccgngggtaaagttcgagggacgtacggggtacaaaccagcgaaccagacgaacgaacggtcccaaacaaaccacaacgccctaaagacgtaggacgtaacgtaacgagacgtagacacgtacgacggacgaccggtaccgacgttaacttaagttacgttaggtagaacggaaggaacggaccgggtaaaccgtagtaaccggtaaccgtaaaccgaaacgtacgggtacggtaacggttaccggggacggggaacccggg

SEQ ID NO: 364550 - DNA, 617 bp, Homo sapiens
  misc_feature: GZ8MTXP02IKD37.52.28.C06.1.454.CMB.2.raw
  modified_base (247)..(247): a, c, t, g, unknown or other
  modified_base (282)..(282): a, c, t, g, unknown or other
  modified_base (307)..(307): a, c, t, g, unknown or other
  modified_base (329)..(329): a, c, t, g, unknown or other
  modified_base (355)..(355): a, c, t, g, unknown or other
  modified_base (385)..(385): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccgtggagcgtctggtacaatctgggactgaggtaaagcgaccgaggggcctcagtgaggtctctgtagctntgactacccataccggctactacttacacgtggtncgacgcggcccctggacaggcttgngtggagtggtagacactccaangtgacggcaccggtcgacacagaatntgcgcggtagttcgagggcagggtcactanacgacgagcgacgacggtaccaacgtaaccacgtaacgcctaacgagtacggaacgtaacgttaaacggtagaccgttaggaacctagttacgtacggaccgtaaacgaccggttaccgtacctttatttaacgtttgtacgttagacgggaaacggacggaaccccgtagtaccggaaccgttaacgaaccgtaggttacgggaccggttacggtacggggaaccccgggg

SEQ ID NO: 364551 - DNA, 652 bp, Homo sapiens
  misc_feature: GZ8MTXP02FKX30.52.28.C06.1.454.CMB.2.raw
  modified_base (293)..(293): a, c, t, g, unknown or other
  modified_base (501)..(501): a, c, t, g, unknown or other
  modified_base (598)..(598): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactaggaaggtaaagacggaccgaggggcctcgagtgaaggtctcctagtaagcttctggactacccataaccgctactactacactgggtncgacacggcccctaggacaagggcttggaggtaggagtggggtagaactaactacccaacgaggtaggggacggccgacccggtccgacaacgaaggtaactagtcggcggtacgggtaaggtttcggaaggggccgaggggtaccaacgagtacgaaccgaggaccgacgacggtacccaaacgaacacacgtacctacagtagganaacgtaagtaacgacgtacgaactagttacgacgaaaccggacgaccgggtaccttattagttaacgttgtaggtacgaggacggacggaacccgtntaccggaacctacgaacgtacggtacgtccgggtacgggtcggggaacccgggg

SEQ ID NO: 364552 - DNA, 555 bp, Homo sapiens
  misc_feature: GZ8MTXP02IZG8Q.52.28.C06.1.454.CMB.2.raw
  modified_base (345)..(345): a, c, t, g, unknown or other
  modified_base (407)..(407): a, c, t, g, unknown or other
  modified_base (462)..(462): a, c, t, g, unknown or other
  modified_base (479)..(479): a, c, t, g, unknown or other
  modified_base (485)..(485): a, c, t, g, unknown or other
tcagcgcagtacgacacgaccggtgctcgatttagagctcacgtattgggttgggggagcatcacccagcaaccacatctgtcctctagagaatccccagagagctccgttcctcaccatggactggacctggaggatcctcttcttggtggcagcagcccacaggagcccactccctggagcgtctggtacaatctgggactgaggtaaagagaccaggggcctcagtgaaggtctcctgtaaggcttcgtggactaccccataaccggctactacttacactgggtgcgacaggcccctggacaagggcttgagtggatggggtgaacaatccaacagtaggnggcaccggtcgcacagaatatgcgcggaagtttcgagggcaggggtcacatgaccagcgacnggtccactacacagacctacatggagctaagtagacgtgaaccatcagacgaacncggacgtcttattagtntaggtnaggagtacggaacccgtattcgaaccgttacgaaacgacgtacgggaacgttcggacgggggtaacccgg

SEQ ID NO: 364553 - DNA, 661 bp, Homo sapiens
  misc_feature: GZ8MTXP02IBPY8.52.28.C06.1.454.CMB.2.raw
  modified_base (251)..(251): a, c, t, g, unknown or other
  modified_base (286)..(286): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactcccgtggagcgtctggtacaatcgtgggactggaggtaaagagaccgagggcctcgagtgaagtctctgtagcttnggactacccataccgctactacttacacgtgggtncgacacggcccctggacgaggcttagaggtggagtggggtaggaacaacgtcccaacgaggtaggaggccgaccgggtcccgacgacgagaactatacggacggcggggtaaaggtttcggaacgggggtaccgtagggggtaccaaccgtagtacgaaccacggacgaacgacgggtaccaaaccgtaaacaaccgacggacctaaacgagtacgggaaacgtacgtaaaggtaacagtagaactagtcgtaagaccgaacgtaccgggtacttacgttaatttacgttggtaggtacgaaagggacggtaccgggaacccgagtacccgaaccgtaaccgaacgtacggtcggaacgtcggtacggggacggg

SEQ ID NO: 364554 - DNA, 602 bp, Homo sapiens
  misc_feature: GZ8MTXP02HWMGL.52.28.C06.1.454.CMB.2.raw
  modified_base (251)..(251): a, c, t, g, unknown or other
  modified_base (338)..(338): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctctgtaaggcttcgnggactacccataaccggctactacttacactggtgcgacgacggccctggacgaaggcgttgagtggagtggggtgaacaatccaangtggaggcacggtccgcacagaatatggcgcgggtaaacgtttcgagggtcgaggggtccacctagtcgaccgagcgacgacggccaactaaacacgagccctagagtacggatcgtaagtacgaacgtgactagtccgtacgaaccgacgtaccgggccgtacgttaacgtttaacgttggttggtagaggaggacgggacccgtaagtccggtaaccgtacggaaaccgagtacggaaccggtcggttacgggggacccggg

SEQ ID NO: 364555 - DNA, 641 bp, Homo sapiens
  misc_feature: GZ8MTXP02J1JXQ.52.28.C06.1.454.CMB.2.raw
  modified_base (383)..(383): a, c, t, g, unknown or other
  modified_base (419)..(419): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctcctgtaggcttctggactacccataaccggctactacttacactgggtgcgacaggcccctggacgaagggcttggaggtggagtgggggtaggaacaacgtcccaaacgaggtagggacggcgaccggtccgacacgagaaatngcggcggaagtttcgagggcgaggggtccaaccgtntacgaccagccgaacgacggtcccaactaacgaacacgacctacagtagggacgtacgtaaagtagaacttacggaactagtcgtaacgaccgtaacgaccggggtcctacttatttacgttggtaggtggaaaggtacggaacgggtaaccccaagttacgaaccccgttaacgaaacgtacggttacggaccggtttacggtacgggggtaaccccgggg

SEQ ID NO: 364556 - DNA, 584 bp, Homo sapiens
  misc_feature: GZ8MTXP02J0UTS.52.28.C06.1.454.CMB.2.raw
  modified_base (488)..(488): a, c, t, g, unknown or other
  modified_base (491)..(491): a, c, t, g, unknown or other
  modified_base (513)..(513): a, c, t, g, unknown or other
  modified_base (524)..(524): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctcagtgaaggtctcctgtaaggcttcgtggactaccccataacccggctactacttacactgggtgcgacacggcccctggacaaggcttggagtggagtggggtaggaaacaacgtacccaacgaggtgggacggccgacccggggtcgaccacagaaatagtcggcggcggggtaaagtttcgaggggcgagggggtaccaccgagtcgaaccgagcgaacgaggtcccaactaacacacgacctacatggagactaagtanacngacatcagacgacgacgtcgtntacttagttgngtagagacggtacggaccgagtcgaaccgtacgaacacgtaggccgtcggtcgggaccgg

SEQ ID NO: 364557 - DNA, 657 bp, Homo sapiens
  misc_feature: GZ8MTXP02JRGAH.52.28.C06.1.454.CMB.2.raw
  modified_base (248)..(248): a, c, t, g, unknown or other
  modified_base (502)..(502): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctggactgaggtaaagagaccgagggcctcagtgaaggtctctgtaaggcttnggactacccataaccggctactactacacgtgggtgcgacacggcccctggacgaagggcttaggaggtagggacgtgggggtacggaaaacaacgtacccaacgtaggtaggggacggccgaaccggtccgaccagaagaaatgtgcgcggggtaaagtttcgaggggtcgacggggtacacagtcgaaccaggccgaacgacgggtacccaactaacaccgagaccctaacgagtaggacgtactaaggganaccgtagactagtcctagggaaccgaccgaccggggtaccttacgttactttacgttggtaggtcggtaaaggacggtaaccggaacccgtaggtaccgaaccgtacggaaaactacgggtaccggtacggttcgggacgggggaaacccccggg

SEQ ID NO: 364558 - DNA, 827 bp, Homo sapiens
  misc_feature: GZ8MTXP02GJ5SX.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcagtgaaggtctccgtagtaaggcttcgtggactaccccaataaccggctactacttacacgtgggtgacgacgaggccccctaggaccgaagggcttagaggtggagttgggggtaggaaactaacgtccccaaagtaggtagggacggccgtaacggtcccggacacgtaagaaacgttagtcggacgtaccggggtaaagttttcccggaagggggtcctaacgggggttaccaaaccgtacgttacggaacccgtaaggcccgaaacgtaccgggttaacccaaaccgttaaaaccaaacgaaccgtacccgttaaaccgtaacggttagggaaacgtaccgttaaaaggttaacgtaaccgttacggtaaacaacgttacccgttaaggtaaccccggtaaaaccggcccgggggttaccccctttaaacgtttaaacgttttaacgttttcgggggttaacggttcgggttaaaagggaaccggttaaacccggggaaaacccttaaaacggtttaacccggaaacccgtttaacgaaaacccggtaggttaaccggggtaccggttaccggttacggggggtaaacccccgggg

SEQ ID NO: 364559 - DNA, 592 bp, Homo sapiens
  misc_feature: GZ8MTXP02GSS3K.52.28.C06.1.454.CMB.2.raw
  modified_base (254)..(254): a, c, t, g, unknown or other
  modified_base (563)..(563): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaaggtaaagagaccgaggggcctcagtgaaggtctcctgtaaggcttcgnggactaccccataaccggctactactacacgtgggtgcgacacggccccgtggaacgaagggcttggaggtggagtggggtaggaacaactaccccaagaggtagggacggccgaccgggtccgacacgagaaatagcggacggcgggtaagtttcgaggggcgagggtacacagtcgaccgagcgacgacggtaccactaacacacgcctacagtaggacgactaaggtaagacctagacatctagacgaacgccggtacgtacttattagttgtgtagagacggtacggacctagtacaaccggtanaacgtagtcggacgttcggacgggaccgg

SEQ ID NO: 364560 - DNA, 663 bp, Homo sapiens
  misc_feature: GZ8MTXP02GR5GS.52.28.C06.1.454.CMB.2.raw
  modified_base (262)..(262): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacgaggacgcccactccctggagcgtctggtacaatctggtactagaaggtaaagagaccgaggggcctcgagtaggaacggtctccgtgtaaggcttcgnggactaccccagtaaccggctactactacacgtgggtgcgacgacggccccgtaggacgaaggcttaggagtggagtggggagaacactacccgaagaggtacggaggccgtaccggtccgacaaccgagaaattacggcggccggacgggtaaacgtttcggacggggtacgtaacggggtcccaaacgtactaccgaccacggtaccgaacgtaccggtaccaaaccgtaacacgacgacctacagttgaagtacgtaaagagtaacgtgaactacgacgtacggaacgaccgaccggtcgttacgttaatttagtacggtgtaggaacggtaaggaccggaaccgtacgacgtaaccgacgtaaacgcggtacgtaccggtacgggtacgggaaccgg

SEQ ID NO: 364561 - DNA, 708 bp, Homo sapiens
  misc_feature: GZ8MTXP02IYWCW.52.28.C06.1.454.CMB.2.raw
  modified_base (291)..(291): a, c, t, g, unknown or other
  modified_base (382)..(382): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgaggggcctcgagtgaaggtctcctgtaaggcttctggactaccccataaccggctactacttacacgtgggtncgacacggcccctggacaaggcttgagtggagtggggtagaacaactcccaacgaggtggaggcaccggtcgccacgagaactagtcgcgngggtaacgtttcgaaggggtcaggggtacacgtagtgaccgacggacacgacggtcccaaactaacaacgacgtaccctaagacgtagggaaacgtaccttaaacggtaagacccttaggaaccctaattaccgttacggaacccggtaaaccgaccggggttacccttaccgtttaacgtttaaacgtttcgggttcggtttacgggtaaaagggtaacgggtaacccggggaaaaccccgttagttaaccggaacccgtttaacggaaaacgtaaacggttcggggtaaaccggttccgggggtaccgggggttaaccccgggg

SEQ ID NO: 364562 - DNA, 669 bp, Homo sapiens
  misc_feature: GZ8MTXP02JI350.52.28.C06.1.454.CMB.2.raw
  modified_base (229)..(229): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctgggactggaaggtaaagagaccgagggcctnagtgaaggtctcctgtaaggcttcgtggactaccccataaccggctactacttacacgtgggtcgcgacgacggccccgtggacgaagggtcttggaggtggagtggggtagaaacaactacccgaacgtaggtggacggccgtaccggtcgaccaagagaaatacgtggcgcggggtaaagtttcggacggggacgtacggggtacaccgtagtacgaaccgagaccgacgacggtacccaaacgtaaccaacgacgtacctaacgacgttagggacgtaacgtaaacgtacgtaactcggaacctacgtcgtaacgaccgaccggtaccggtaccgttacttaacgtttacgttggtaggtagtaacggaacggaccggtaacccgtagacgtaaccgacgtaacgtaggtacggaccgttcggacggggtacccggg

SEQ ID NO: 364563 - DNA, 674 bp, Homo sapiens
  misc_feature: GZ8MTXP02FRQG2.52.28.C06.1.454.CMB.2.raw
  modified_base (249)..(249): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggagatcctcttcttggtggcagcagccacaggagcccactccctggagcgtctggtacaatctgggactgaggtaaagagaccaggggcctcgagtgaagtctcctgtaaggcttntggactaccccagtaccggctactactacactgggtgcgacacggcccctggacaagggcttgagtggagtggggtaggaacaactcccaaacgagtgggagccgaccggtccgacacgaagaatagtcggcggaccggggtaaagtttaccggagggggtccgtaagggggttaccaacccgaagtaccgaccgacggaccgaacgtacggtaccctaaactaaaccaaccgaacggacccttaaccgaagtagggaaacgtaaccgtaaaaggttaacgaacgttacggaaacctaacgttcgaacggaaccggaccgttaaccgggcccttacgttaatttagttggtgtacggaggaagaccggaccgagtacggaaccctacgaaagacgttacgggacgttccggacggggaacccggg

SEQ ID NO: 364564 - DNA, 599 bp, Homo sapiens
  misc_feature: GZ8MTXP02H9YMQ.52.28.C06.1.454.CMB.2.raw
  modified_base (249)..(249): a, c, t, g, unknown or other
  modified_base (559)..(559): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactcccctggagcgtctggtacaatctgggactgaggtaaagagaccagggcctcagtgaaggtctctgtaaggcttnggactaccccataaccggctactacttacactagggtgcgacacggcccctaggacgaagggctttggaggtggaggtggggtaggaaacaaactccccaaacgaggtagggacggcgaccgggtccgaccacagaatatgcggcggaagtttcgaaggggtcaggggtcaacgatcgaccagcgacacggtcccaataaaccacacgaccctacgagtaggacgaacctaaaggtacgaactgacacgttcgacgaacgacaccgggaccgtattaacttaatggtagtagaagaggacggaccgttancgaaccgtacgaaactgacggacgtcgtacggggacccgg

SEQ ID NO: 364565 - DNA, 651 bp, Homo sapiens
  misc_feature: GZ8MTXP02IPIUX.52.28.C06.1.454.CMB.2.raw
  modified_base (252)..(252): a, c, t, g, unknown or other
  modified_base (446)..(446): a, c, t, g, unknown or other
  modified_base (524)..(524): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggagatcctcttcttggtggcagcagccacgaggacgcccactccctggagcgtctggtacaatcgtgggactggaaggtaaagagaccgagggcctgagtgaagtctctgtagtctcgngactacccataccggctactactacacgtggtcgcgacacggccccgtaggacgaaggcgttaggaggtggacggtggggtaacgaaacgaactacccgaaagtaggtaggacggaccgaccggtccgacgaacgagaaactagtacggacggtcggtaaggtttccggaggggtacgacgggttaccacgtanacgaccgagaccgtacgacggtaccctaacaacacgacgtacccaagtagaggacgtacgtaaaagtacgacacgganacgttcgacgaccgaacggcccggtacctattaacgtttatggttagtaggaaacgtacggacggaaccgtagtacgtaaccgtacggaaaaccttggaccggtacggttcgggacgggaaccgggg

SEQ ID NO: 364566 - DNA, 568 bp, Homo sapiens
  misc_feature: GZ8MTXP02FVWCA.52.28.C06.1.454.CMB.2.raw
  modified_base (227)..(227): a, c, t, g, unknown or other
  modified_base (248)..(248): a, c, t, g, unknown or other
  modified_base (283)..(283): a, c, t, g, unknown or other
  modified_base (288)..(288): a, c, t, g, unknown or other
  modified_base (359)..(359): a, c, t, g, unknown or other
  modified_base (403)..(403): a, c, t, g, unknown or other
  modified_base (430)..(430): a, c, t, g, unknown or other
  modified_base (484)..(484): a, c, t, g, unknown or other
  modified_base (517)..(517): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatctgggactgaggtaaagagaccaggggcctnagtgaaggtctctgtagcttntggatacccataccggctactactacacgtgggtncgacncggcccctggacaagggctgagtggagtggggtagaacaatcccaagagtggagcacggtcgcacagaatngacgcggtaattcgagggcgagggtcacgatgaccgagcgaacncggtaccaactacactacgcctaacgngtagggacaacgttaagacgactaggaacattcgacggacgacgcggacccttntaatttagtggtagcggaagagaccgggaaccngtaccgaaccgtacgaaacgtaggtcggaccggtcggacgggggaacccgg

SEQ ID NO: 364567 - DNA, 650 bp, Homo sapiens
  misc_feature: GZ8MTXP02I98Y8.52.28.C06.1.454.CMB.2.raw
  modified_base (258)..(258): a, c, t, g, unknown or other
  modified_base (584)..(584): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtggactgaggtaaagacgaccgaggggcctcagtgaaggttctcctagtaaggtcttcgnggactaccccgagtaaccggctaactacttacactgggtgcgacacggcccctaggaacgaggtcttaggaggtggaacgtggggtagaactaacgtacccgaagtaggaggacggacgtaccgggtacgaccacgaagaagtagtacgcggtacggggtacggttacgaacggggcgtaacggggtccaaacgactacgaccgacggtacgaacgtacggtaccaacaaccacgacgtacccaagagtacggaacgacgttaaagacgtaccgaggtaactaacgtcacgaccgacgtaaccgggtcctacgtaatttacgttgnggtacgagacggacgtacgcgtacgaaccgtacgaacgtgtacggaccgtcgggacggaacccggg

SEQ ID NO: 364568 - DNA, 555 bp, Homo sapiens
  misc_feature: GZ8MTXP02GH6X4.52.28.C06.1.454.CMB.2.raw
  modified_base (227)..(227): a, c, t, g, unknown or other
  modified_base (252)..(252): a, c, t, g, unknown or other
  modified_base (410)..(410): a, c, t, g, unknown or other
  modified_base (454)..(454): a, c, t, g, unknown or other
  modified_base (470)..(470): a, c, t, g, unknown or other
  modified_base (502)..(502): a, c, t, g, unknown or other
  modified_base (519)..(519): a, c, t, g, unknown or other
  modified_base (537)..(537): a, c, t, g, unknown or other
tcagcgcagtacgacacgaccggtgctcgatttagagctcacgtattggggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccaggggcctnagtgaaggtctcctgtaaggcttcnggactacccataccggctactacttacacgtggtcgcgacgacggccctaggacaaggcttggagtggagtggggtagaacagtacccaagagtggaggccgaccggtcgacacaagaactatgacgcggtaagtttcgaggggcgaggggtcactanacgacgagcgacaggtacccaactaacacagcctacagtagganactaagtagactaganattcgagacgacgacggcgtactattacgtgngtagagagacgaccgancgaaccgtacgactacgngacgtcggtcgggaccgg

SEQ ID NO: 364569 - DNA, 714 bp, Homo sapiens
  misc_feature: GZ8MTXP02HTRGJ.52.28.C06.1.454.CMB.2.raw
  modified_base (226)..(226): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggagatcctcttcttggtggcagcagccacaggagcccactccctggagcgtctggtacaatctgggactgaggtaaagagaccgaggggcctnagtgaagtctcctgtaaggcttctggactaccccataacccggctactacttacacgtgggtgcgacacggcccctggacgaaggcttggacgtggagtggggtaggaaacaagtcccgaaacaggtaggaggccgaccgggtccgaccacgaagaactatcggacgcgggtaagtttcgaggggaccaggggtccacgtagcgaaccgaagccgaacgacggtaccctaaacgtaaaccgacgaacgaccctaacgagttaggaacgtacgtaaaaggttagaaccgtaggaactaacgttaccgtagggaaacccgtaccgaaccccggggtaccggtttaacctttaagtttaaaccgtttgggttagggttaacgaagggttaacgggaaccgggtaacccccggtaagttaaccggaacccgttaacggaaaacgttacggtacgggtaaccccggttacggggttccggggtaaccccgggg

SEQ ID NO: 364570 - DNA, 552 bp, Homo sapiens
  misc_feature: GZ8MTXP02GIXXG.52.28.C06.1.454.CMB.2.raw
  modified_base (213)..(213): a, c, t, g, unknown or other
  modified_base (226)..(226): a, c, t, g, unknown or other
  modified_base (249)..(249): a, c, t, g, unknown or other
  modified_base (285)..(285): a, c, t, g, unknown or other
  modified_base (339)..(339): a, c, t, g, unknown or other
  modified_base (366)..(366): a, c, t, g, unknown or other
  modified_base (426)..(426): a, c, t, g, unknown or other
  modified_base (434)..(434): a, c, t, g, unknown or other
  modified_base (443)..(443): a, c, t, g, unknown or other
  modified_base (463)..(463): a, c, t, g, unknown or other
  modified_base (483)..(483): a, c, t, g, unknown or other
  modified_base (487)..(487): a, c, t, g, unknown or other
  modified_base (504)..(504): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagngaccaggggcctnagtgaaggtctctgtaaggcttnggataccccataaccggctactacttacactgggtncgacacggcccctggacaagggcttgaggtggagtgggggtgaacaatcccaanaggtggaggcacggtcgcacagaatangcgcggaagttcgagggcagggtcacatgacagcacaggttcccaacaacacaggtccantacggganactaaggtnactgactatcgagacgaacncgggtcctattaattgttgngtanaggacgacgggaccttnacggaaccttcggaaaactcggtagacgttcggcggggaaacccgggg

SEQ ID NO: 364571 - DNA, 637 bp, Homo sapiens
  misc_feature: GZ8MTXP02GXQ0C.52.28.C06.1.454.CMB.2.raw
  modified_base (254)..(254): a, c, t, g, unknown or other
  modified_base (609)..(609): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaggtaaagagaccaggggcctcgagtgaaggtctccgtgtaaggcttcnggactaccccataccggctactacttacacgtgggtgcgacgacggcccctggacaagggcttggagtggagtggggtagaacaacgtacccaagaggtggacggcgaccggtcgaccgacgaagaactagtcggacggacgggtaacgtttcggacggggtcgaacggggtccaaccgagtacgaccgaggacgacgatcgtaccaaccgtaaacacgacgtacctaacgtacgtaggtaacgtacgtaaagtacgtactagaacctagtccgtaggacctacgaccgggtcctaacttattacgtggtagtacggacgacggaaccgtacccgtagcgtacccgtaagaaccnggttaccggacggtttacggaccggggg

SEQ ID NO: 364572 - DNA, 604 bp, Homo sapiens
  misc_feature: GZ8MTXP02FRE6O.52.28.C06.1.454.CMB.2.raw
  modified_base (329)..(329): a, c, t, g, unknown or other
  modified_base (379)..(379): a, c, t, g, unknown or other
  modified_base (464)..(464): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaggtaaagagaccgaggggcctgagtgaaggtctcgtgtaaggcttcgtggacacccataccggctactacttacacgtgggtgcgacgacggcccctggacagggcttggagtggatggggtnaacagtacccaagagtgggacgcgaccggtcgacacgagtaactagtcgngacgggtagttcggaggcgtacggtacaccgatacgaccaggtacgaacgtacggtaccaacctaacgacgtacgactaccaagngggtaacgacgttaaagtacgacgtacgacacgttcacggaacgacgtaccgggtcctgttaattcgttgtagtagaggaggaccgaccgagtacgtaaccgaagtaacctggtacgtacggtccggacgggtaacccgg

SEQ ID NO: 364573 - DNA, 586 bp, Homo sapiens
  misc_feature: GZ8MTXP02IJQHI.52.28.C06.1.454.CMB.2.raw
  modified_base (211)..(211): a, c, t, g, unknown or other
  modified_base (384)..(384): a, c, t, g, unknown or other
  modified_base (482)..(482): a, c, t, g, unknown or other
  modified_base (561)..(561): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggagatcctcttcttggtggcagcagccacaggagcccactccctggagcgtctggtaccaatctggactgaggtaaanagaccagggcctcagtgaaggtctctagtaaggcttctggactaccctataaccggctactacttacactggtcgcgacacggcccctaggacaaggcgttgaggtggagtggggtacggaacaactacccgaagaggtggacgcgaccggtccgcacagaactagtggacgngggtaatttcgagggcgagggtcactatcgacagacgacacggtccaacgtaacacgtacgacctacagtacgagacctaagtagaccgtagaacgtntacgagacgaccgtaccgggtccttactatttaagtcgtgtagacggagacgaccgactacgaaccgtacgtaaaccgngtacggccgtacggtcggggaccgg

SEQ ID NO: 364574 - DNA, 612 bp, Homo sapiens
  misc_feature: GZ8MTXP02IGQP6.52.28.C06.1.454.CMB.2.raw
  modified_base (230)..(230): a, c, t, g, unknown or other
  modified_base (254)..(254): a, c, t, g, unknown or other
  modified_base (259)..(259): a, c, t, g, unknown or other
  modified_base (270)..(270): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactggaaggtaaagagaccgaggggcctnaggtgaaggtctcctagtaaggtnttcgnggactacccanaaccggctactactacacgtgggtgcgacgacggcccctaggacgaacgggtcgttggaggtggagtagggggtaggaaacaaagtcccaacgaggtacgggacgacgaccggtcccgacgaacagaaatagtgacgcggtaacggtttcgagggacgaggtcacgagtcgacgagacgacgaacggtcccgaacaaccacgacgacctacagtacggacgaacttaagtagactagacagttcacgacgacgacggaccgtacatttactagttgagaaggcggacgacccggtataccgaaccgacgaaacgagtacggacgtcggtacggggacccggg

SEQ ID NO: 364575 - DNA, 606 bp, Homo sapiens
  misc_feature: GZ8MTXP02G5YII.52.28.C06.1.454.CMB.2.raw
  modified_base (226)..(226): a, c, t, g, unknown or other
  modified_base (287)..(287): a, c, t, g, unknown or other
  modified_base (344)..(344): a, c, t, g, unknown or other
  modified_base (552)..(552): a, c, t, g, unknown or other
  modified_base (579)..(579): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaggtaaagagaccgagggcctnagtgaaggtctctgtaaggcttcgtggactacccataaccggctactactacacgtgggtncgacacggcccctaggacaagggcttggagtggagtggggtagaacaagtcccaaanagtgggacgtccgacggtccgacacaagaactgtgacggtcgggtaaattcggacggggtacagggtaccaacgacgtagaaacccaggtaccgaaaccgagggttaccccaaataacccagaacgtaccctaagagtaggggactaacgtaaagtaacgacctaggaccagtacgacggacaacggttacggcttactattacgtgngtacgagtagcgacctatacgaaccgngaaactaggcggacgtcggtacggacg

SEQ ID NO: 364576 - DNA, 633 bp, Homo sapiens
  misc_feature: GZ8MTXP02GIKMW.52.28.C06.1.454.CMB.2.raw
  modified_base (216)..(216): a, c, t, g, unknown or other
  modified_base (279)..(279): a, c, t, g, unknown or other
  modified_base (290)..(290): a, c, t, g, unknown or other
  modified_base (298)..(298): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactgaaggtaaagngaccgaggggcctcgaggtgaaggtctcctggtaaggcttgtggactaccccaagtaaccggntactacttacncgtgggtncgacacggcccctagacgaaggcttgagtggagtggggtagaacaactcccgaaagaggtaggaggacgaccggtccgacacaagaatagtgcgcgggtaattcggaggggtacgacgggtcaaccgagtacgaaccacggcgtacgacggtacccaagaaaccacgtaacgcctaacgagtaggacgtactaaaggtacgaagttacgaactagtacgtaggaaccgtaccgaacggtcccgttattaagtttacttggagtaggagaacggaccgtaaccgagttacgaaccgtacgaaactcggtaaggtccgttacggacggggtacccgg

SEQ ID NO: 364577 - DNA, 573 bp, Homo sapiens
  misc_feature: GZ8MTXP02F1OB8.52.28.C06.1.454.CMB.2.raw
  modified_base (248)..(248): a, c, t, g, unknown or other
  modified_base (284)..(284): a, c, t, g, unknown or other
  modified_base (374)..(374): a, c, t, g, unknown or other
  modified_base (476)..(476): a, c, t, g, unknown or other
  modified_base (499)..(499): a, c, t, g, unknown or other
  modified_base (555)..(555): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaaggtaaagagaccgagggcctcgagtgaagtctctgtagcttntgactacccataaccggctactactacacgtgggtncgacacggcccctaggacgaagggcttaggaggtggaggtcggggtggaaactaacgtacccaagtaggtgacggcaccggtccgaccanaagtaatatggcgcgggtattacgaggggcaaggggtcacgatgaccagcgaacgtacggtaccaacaaccacgacgcctaacgagtacggatacgtaaganactagactactgtacgacgaacncgaccgttatattagttgtagtgagagacggaaccagtacgaacctacgaacgtanggacgtcgacgggaccgg

SEQ ID NO: 364578 - DNA, 690 bp, Homo sapiens
  misc_feature: GZ8MTXP02F1O29.52.28.C06.1.454.CMB.2.raw
  modified_base (259)..(259): a, c, t, g, unknown or other
  modified_base (295)..(295): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactcccctggacgcgtcgtaggtacaatcgtgggactggaaggtaaagagaccgagggcctcgagtgaaggtctctgtagtcttcgnggactacccgataaccgctactactacagtgggtcncgaccgcggccccgtaggacgaagggcttaggaggtggagtggggtagaaactacgtacccgaacgaggtggacggccgaccgggtccgcgacgaaggaattagtcggcggtagggtaaacgtttcgggagggtcggtacggggtacgaaccagtccgaacgacggaccgaaccgaacgggtacccaaacgtaacccaggaaccacccttaacgaagtacggaacgaacgttaacggtaacgtacgtacgaactacgttaccggacgtaaccggaaccgtaccgggtacctacttaacgtttcgttagggttgtacgggaaggacggtaccggaacccgtagtaccgaacgtacgaaccgtagtaccgggacggtacgggaccggggtacccggg

SEQ ID NO: 364579 - DNA, 673 bp, Homo sapiens
  misc_feature: GZ8MTXP02JNDG2.52.28.C06.1.454.CMB.2.raw
  modified_base (251)..(251): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatctgggactgaaggtaaagagaccgagggcctgagtgaggtctctgtaagtcttcgnggactacccataaccggctactactacacgtggtcgcgacgacggcccgtggacgaaggctaggaggtcggagtaggggtacggaaacaacgtcccaagtaggtggacggccgaccggtcccggacaacgagaaagttagacggcgaccgggtaagtttcggacggggtacgaggggtacaccgagtaccgaacgacgaccgaacgacgtacccaactaacgaactacgccctacgagtacggacgtaacgttaacggaaggacttacggaactaagtccgtaagggaaacccgcggtaaacccgggtccgttaacgttacttttaaggttcgggttagtacggaggtacggaaccggggtacccagtacggaacctacgaaaccgtcggtacggaccggtttacgggacggtaacccgggg

SEQ ID NO: 364580 - DNA, 631 bp, Homo sapiens
  misc_feature: GZ8MTXP02IQ5B0.52.28.C06.1.454.CMB.2.raw
  modified_base (249)..(249): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggacgcccactccctggagcgtctggtacaatcgtgggactggaggtaaagagaccgaggggcctcagtgagtctctgtagcttntggactacccataaccggctactacttacacgtgggtcgcgacgacggcccctggacgaaggcttgagtggagtggggtagaacactcccaagagtggacgcgaccggtcgcacagatagtcgcgcggtaacttcggagggcagggtcaccatcgaccagcgaacgacggtacccaactaccacgacgactacgagttagacgtacgtaaaggtacgactaggaacctactcgtacggaaccgacgtaaccggtccgttaccttaagttttagttcggtagtaggtaaacggacggggaaccggaaccccggttaattacccggaaccgttacggaaaccgtacgtacgggtaccgttcggggtaccgggggtaccccgggg

SEQ ID NO: 364581 - DNA, 638 bp, Homo sapiens
  misc_feature: GZ8MTXP02GRXMX.52.28.C06.1.454.CMB.2.raw
  modified_base (297)..(297): a, c, t, g, unknown or other
  modified_base (464)..(464): a, c, t, g, unknown or other
  modified_base (565)..(565): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactggaaggtaaagagaccgaggggcctcgagtagaaggtctctggtaaggcttcgaggactaccccagtaaccggcttactacttcacgtgggtncgacacggcccctggaacaggcttggacgtggagtggggtgaacaatccccaagacgtggacggcgaccggtcgacgacaacgatagtcgacggcggtagtttacgacgggagtaggggtccacgagtacgacccaaggcgtaacgaccgggtaccaacgtaaaccncgaacgccgttacaagttacgggagtaaccgttaaaggagacctagaacgtacacgttacggaccgaaacgccggtaccgtacttaagttaacgttggttntacggaagaacggtaccgaacccggtatacgaacccgtagaaaacctgttacggacgtcggtacgggcccggg

SEQ ID NO: 364582 - DNA, 801 bp, Homo sapiens
  misc_feature: GZ8MTXP02HJCLU.52.28.C06.1.454.CMB.2.raw
tcagcgcagtacgacacgaccggtgctcgatttagagctcacgtattgggtttgggggagcatcacccagcaaccacatctgtcctctagagaatccccagagagctccgttcctcaccatggactggactggaggatcctcttcttggtggcagcagccacaggagcccactcccgtggacgcgtctggtacaatcgtgggactggaacggtaaagaggaccgaggggcctacgaggtaggtaaggtctccgtaggtaaggtcttcgtaggactaaccccaagtaacccggtactaccgtaacttacgacgttgggtcgaccgacgtaccggcccccgttagggaaaccgtaacggggtacttacggggtaggttacggggtaaggtcgggggtaacggaaaacctaaaccgtaccccgaaaacgtaagggtcggggacggaaccgtaccgggtaccggacgaaacgacggtaaatacgtcgggacgacgggggtaaagttttccggaaacgggggtaccgtacgggtaccgaaccgtacgtaacgaacccgaacgaccggtaacgacgggtacccaaacgtacaacgtaacgacccttaacgaggtaacggtaacgtactaaaagggtactaacgggtataacgacgttacgtacgggaccgtaacgtaccgggtacccgttacgttaatttaccggtgttagggacggtaacggtacggaccggaaccggtaagttcccgaaacgttacggaaacgttacggtacgggtaaccggtccgggttacgggggaacccggg

SEQ ID NO: 364583 - DNA, 614 bp, Homo sapiens
  misc_feature: GZ8MTXP02JOPOC.52.28.C06.1.454.CMB.2.raw
  modified_base (215)..(215): a, c, t, g, unknown or other
  modified_base (269)..(269): a, c, t, g, unknown or other
  modified_base (287)..(287): a, c, t, g, unknown or other
  modified_base (295)..(295): a, c, t, g, unknown or other
  modified_base (300)..(300): a, c, t, g, unknown or other
  modified_base (381)..(381): a, c, t, g, unknown or other
  modified_base (550)..(550): a, c, t, g, unknown or other
tcagcgcagtacgacacgaccggtgctcgatttagagctcacgtattgggtttgggggagcatcacccagcaaccacatctgtcctctagagaatccccagagagctccgttcctcaccatggactggacctggaggatcctcttcttggtggcagcagccacaggagcccactccctggagcgtctggtacaatcgtgggactgaaggtaaagngaccgaggggcctcaggtgaaggttctccgtgtaagcttctggactaccccganaaccggctactactaacncgtgggtncgacncggcccctaggacgtaacggcgttgagtggagtggggtagaaacgtactacccgaagtcggtaggacggaccgacgggccnccaagtagaaaattagcggacggacggtaagtttcggacggggctagggacaccagtacgaccgaagacgtacgacggtacccaacgaacgacacgtacctacgagacgggaatacgtaaagtacgacgcgatacgcgacgacgacgaacggtcctagtattctaggtnacgagaacgtacggacctagtacgaaccttagaaccgtagtacggcgttacggacgggacccgg

SEQ ID NO: 364584 - DNA, 559 bp, Homo sapiens
  misc_feature: GZ8MTXP01C3PAB.2.41.D08.1.454.CMB.2.raw
  modified_base (408)..(408): a, c, t, g, unknown or other
  modified_base (540)..(540): a, c, t, g, unknown or other
  modified_base (542)..(559): a, c, t, g, unknown or other
tcagacgctcgacacacgaccggtgctcgatttagtcacgcgagaaagggaaaggggctggaatatgttgcaactattactactaatgggggtagtacatattatgcaaactctgtaaagggcagattcaccatctccagagacaattccaagaacaccttatatcttcaaatgggcagcctgagagttgaggacatggctgtgtattactgtgcgagagagtgggggatagttgtggtggtgtattgttcttttattacgaagaaggaggaaacgttgggggaccgactattaataaactacgctatggacgtcgtggggaccaaggaccacggtcaccgtctcctcacgcctaccaccaacggcccactcccggtccttccctgcccaccctccctaccaacgacnccacctcgtgggggccacgacgccggcccgtgggctcgccgtggtacgaacggtaccttaccgttccgtcgtccggacgtccgttcggtcggtacgggccgggtaccgtgggaccgaacgggcgacagtagngnnnnnnnnnnnnnnnnnn

SEQ ID NO: 364585 - DNA, 497 bp, Homo sapiens
  misc_feature: GZ8MTXP02IPWYO.2.41.D08.1.454.CMB.2.raw
  modified_base (387)..(387): a, c, t, g, unknown or other
  modified_base (443)..(443): a, c, t, g, unknown or other
  modified_base (455)..(455): a, c, t, g, unknown or other
  modified_base (485)..(497): a, c, t, g, unknown or other
tcagacgctcgacacacgaccggtgctcgatttagtcacgcgagaaagggaaagggctggaatatgttgcaactattactactaatgggggtagtacatattatgcaaactctgtaaagggcagattcaccatctccagagacaattccaagaacaccttatatcttcaaatgggcagcctgagagttgaggacatggctgtgtattactgtgcgagagatggggtatattgtggtggtgattgtcttttattcgaagaagaggaaacttgggggccgactattataactacgctatggacgtctggggccaagggaccacggtcaccgtctcctcagcctccaccagggcccatccggtcctccccctggccacccctcctccagngccaccctcgtcgggggcacgacgcgccctgggctgcctggtcaaggctacttccngtcgagcgttcngtaggccgggctgggccaagggcgcatagnnnnnnnnnnnnn

SEQ ID NO: 364586 - DNA, 679 bp, Homo sapiens
  misc_feature: GZ8MTXP01A2AW3.45.70.G04.1.454.CMB.2.raw
  modified_base (225)..(225): a, c, t, g, unknown or other
  modified_base (298)..(298): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctcctgcactggaaccngcagtgacgttggttattataactatgtctctggtacaacaacaccagcaaacgccccaaactcatgatttangatgtcagtaactcggccctcgtagggggtttctgtactcgtcttctctcggtctaccaagtcctagggtaccaacgaccggtccctccctacgaaccctacgttccgtcccgggtccgtcccgtacggaccggtcggtacgggaacggacgggacgttcggttaacgtttaaacgttaccttaggtcgtaacggtaccgtactaacgttaacttacgtccgaaccgaccgacgtaccgtacttaacggtaccttaccgttaacggttaacgtttcggggacggggaaccggggttaaccgaacggtaccgttccggttaccgttacccgtaagggtaccgtaacgacccggtacggaccgtcccgttccccgttccccgg

SEQ ID NO: 364587 - DNA, 593 bp, Homo sapiens
  misc_feature: GZ8MTXP01BNEYZ.45.70.G04.1.454.CMB.2.raw
  modified_base (225)..(225): a, c, t, g, unknown or other
  modified_base (302)..(303): a, c, t, g, unknown or other
  modified_base (331)..(331): a, c, t, g, unknown or other
  modified_base (407)..(407): a, c, t, g, unknown or other
  modified_base (465)..(465): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcacatctcctgcactggaaccngcagtgacgttggttattataactatgtctcctggtaccaacaacacccaggcaaacgcccccaaatcatgatttannatgtcagtaatcggccctgagggtttcngatcgcttctctggctacaagtctaggaccaacgaccggtccctccctcgaaccctatccgttccggcgtccacgngtcgaggacggagcgtagtagttattacgtgtcagtcgtctatatacggcacgcgacncgactgtacgtacttaggttaaacgttcgggaccggggaacgggaaccgaacgtcggttaccgttaccggttacccgttaacggtaccgaacgacccggaaccggttcgtcccgttccccgttcccgg

SEQ ID NO: 364588 - DNA, 538 bp, Homo sapiens
  misc_feature: GZ8MTXP01EIL8V.45.70.G04.1.454.CMB.2.raw
  modified_base (225)..(225): a, c, t, g, unknown or other
  modified_base (248)..(248): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctcctgcactggaaccngcagtgacgttgtattataactntgtctctgtacaacaacaccagacaaacgccccaatcatgatttatgatgtcaagtatcggcctcgtagggtttctgatcgcttctcctggtctaccgaagtctacggacaacgacgccctccctgacctatctctcgggctcgagctggaggacgaggtctagtattattactgacaggtctacaatcgtgcacgcagtcatgacctgtaagttacgttcgggacggaacgggacaacggcttcggacccggtcgtacggtcaacgcccgaaggtccttccgtcccccg

SEQ ID NO: 364589 - DNA, 645 bp, Homo sapiens
  misc_feature: GZ8MTXP01CFBSA.45.70.G04.1.454.CMB.2.raw
  modified_base (301)..(301): a, c, t, g, unknown or other
  modified_base (416)..(416): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcacatctcctgcactggaaccagcagtgacgttggttattataactatgtctctggtaccaacaacacccaggcaaacgccccaaatcatgtatttangatgtcaagtaatcggccctcgtaggggtttctgactcgtcttctcccgtcgtctacgtagtcgtacgacaaccgaccgtccctccgcgaacctctctcggtcggtcctaccggngtcgaggacggacggtacggtcttaagttactttaacgttacgttcgaccggtaccgtacttacgtaacttacgtacgccgaccggactacgactaacgtcgttaccttacggttaacggttacgggttcggggtaaccggggaccggtaaaccgacggttaccgttccggttacccgtaacgtacgtaaccgacccggacccggacggtccgttccccgttccccggg

SEQ ID NO: 364590 - DNA, 669 bp, Homo sapiens
  misc_feature: GZ8MTXP01D96IS.45.70.G04.1.454.CMB.2.raw
  modified_base (255)..(255): a, c, t, g, unknown or other
  modified_base (305)..(305): a, c, t, g, unknown or other
  modified_base (313)..(313): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacaggcgatccaccatcctcctgcacgtggaaccagcagtgtacgttgttatatactntgtctctgtacaacaacaccagacaaacgaccccaaactcatgtatttangtatgtanagtaactccggcctcgtagggtttctagtatcgtcttctcctacggctaccgaagttcctaggaaccctaacgaccggtcccttcccgtacaccctatccgtcgtcgggtccctaccggaggtccgtaggacgggtaacggaggtacttagtattaacttacgtacgactaacggtcttacaattactacggaccacggaccaaggtccaagttacggtaccttacggttaagttccgggttacggggaccgggaaacgggtaaccaaagggttcccgttaacggttaccccggttcggttacggtcccgaacccgggacccgttaccggggtccccttaacccggtcccccccgg

SEQ ID NO: 364591 - DNA, 583 bp, Homo sapiens
  misc_feature: GZ8MTXP01BNGW2.45.70.G04.1.454.CMB.2.raw
  modified_base (226)..(226): a, c, t, g, unknown or other
  modified_base (298)..(298): a, c, t, g, unknown or other
  modified_base (362)..(362): a, c, t, g, unknown or other
  modified_base (437)..(437): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctcctgcactggaaccngcagtgatgttgggattataaccttgtctctggtaccaacagcaccagacaaacgccccaaatcatgattangaggcagtaacgcggcctcgtagggtttcaagtcgtcttctcgtcgctcgaagtctgaacaacnccggcctcccgtgacactctcgtcgggctcgaggctaggaggacgaggtctagtattaacttacgtgcttgcctntaagttagtcgtagtaggttagttagttaggttttcggtaggttccgggcgggaggaaccgtaaggttccgtacgttccgtcgtacggcgttacgcccgaagtcccgtccgtaccccgtggttaccctaacgttccgttaaccccg

SEQ ID NO: 364592 - DNA, 713 bp, Homo sapiens
  misc_feature: GZ8MTXP01CYJX8.45.70.G04.1.454.CMB.2.raw
  modified_base (252)..(252): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacaggcgatcaccatctcctgcactggaaccagcagtgacgttgttattataactatntctctgtaccaacaacaccaggaccaaacgaccccaaactcatgtatttatagtatgtacagttaactccggccctcgtaggggtttctgtactcgtcttccgtccgtcggtctacaacgtcgtacgggacctaacgaccggtccctacccgtacgaccacttctcgttcgggtcctccggacggtcgtacgggaacgggtacggaacgggtccttaggtaactttacgttaacgttggacctaaggggtccttaacgtacttaagttccgaccgaacggtccaaggtaccttaaagtccggtaacctttccgttaaggttacggtttacccgggggaaaccgggttaacgggaaaccccgtaaggttacccggttaccgggttaacccggttaacccggtaacggttcccgaaacccggacccgttaaccgggtaacccgttccccgggttcccccccgg

SEQ ID NO: 364593 - DNA, 609 bp, Homo sapiens
  misc_feature: GZ8MTXP01C5QR4.45.70.G04.1.454.CMB.2.raw
  modified_base (438)..(438): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacaggcgatcaccatctcctgcactggaaccagcagtgacgttggttattataactatgtctcctggtaccaacaacacccaggacaaacgacccccaaactcatgatttatgatgtcagtaatcggccctgtaggggtttctgatcgcttctcctggctcaagtctaggcaacgaccggccctccctcgaccatcctcgtgggcctccgaggctggaggacgaggtctagtattattactgcnggtctctaatacgtgaccgacgcgacgctagtacggaccttcgttaaggttacgttccgggggaccggggttaaacggggaaacccgtaaggttcccgttccggaccccggttaaccgtacggggtcccacggaccccgaacggggtcccttaaccccgggtcccccccgg

SEQ ID NO: 364594 - DNA, 671 bp, Homo sapiens
  misc_feature: GZ8MTXP01DWVJF.45.70.G04.1.454.CMB.2.raw
  modified_base (207)..(207): a, c, t, g, unknown or other
  modified_base (225)..(225): a, c, t, g, unknown or other
  modified_base (249)..(249): a, c, t, g, unknown or other
  modified_base (285)..(285): a, c, t, g, unknown or other
  modified_base (296)..(296): a, c, t, g, unknown or other
  modified_base (489)..(489): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacaggcatcaccntctctgcacgtggaaccngcagtgtacgttgttatataactntgtctctgtacaacacaccagacaaacgcccaaatnatagtatttangtatgtactaagtaacgtccggtaccttcggttaggggtttctagtacgttccgtctttcctccgtcggtactcgaaagttccgtaacggacctaaccgaccggtcccctacccgtacgacctactccgtcgtcggggtctccggaggtccgtaggaacgggacgtagggtactaggtaactttacgttaacncggtacagggtcctagtataatcggaccacggacacgtactaacgtacgtaacgttacggttaacggttccgggttaccggggaccgggaaacggtaaaccgtacggttaccgttaccgggttacccgttaaccggtaacggcccgacccggtaccggttacgtcccgttccccggtccccg

SEQ ID NO: 364595 - DNA, 517 bp, Homo sapiens
  misc_feature: GZ8MTXP01E17BB.45.70.G04.1.454.CMB.2.raw
  modified_base (434)..(434): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttgttattataactatgtctctgtacaacaacaccaggcaaacgccccaaactcatgatttatgatgtcagtaatcggcctgaggggtttctgactcgtcttctcctggctacaagtctaggacaacgaccgcctccctgaccatctcgtcggctccgaggctgaggacgaggctagattatactgacaggcttcatangacacgcagcatgactctaagtagttcgggacggagggaccaagcgttcgaccgtcaggtccacgccacggtcttccgccccg

SEQ ID NO: 364596 - DNA, 640 bp, Homo sapiens
  misc_feature: GZ8MTXP01A1SLI.45.70.G04.1.454.CMB.2.raw
  modified_base (206)..(206): a, c, t, g, unknown or other
  modified_base (224)..(224): a, c, t, g, unknown or other
  modified_base (249)..(249): a, c, t, g, unknown or other
  modified_base (300)..(300): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacaggcatcaccntctcctgcactggaaccngcagtgacgtttgtaattataactntcgtctctagtaccaacaacaccagacaaacgccccaaatcatgtatttangatggacagtaacgccgtcctagtagggtttactacgtcgtcttctcgtcggactacgagtctggaaccaacgccggtccctaccgtacgaactaactccgtcgtcggggtcctaccgaggcgtacgggaacggacggtaggtcttaggtactttacgttacgtggtcttcgtactacgtaattacgtaggtacgtaggttagttacggtttaggtttgggtcggttcggggacggtacgggtaacgtaacggttcgtaccggaccgttacgtaagggttccacggacccggtaacgtccgtcccgtccccgtcggttaccttcccgttccgtttccccg

SEQ ID NO: 364597 - DNA, 530 bp, Homo sapiens
  misc_feature: GZ8MTXP01EJQI2.45.70.G04.1.454.CMB.2.raw
  modified_base (254)..(254): a, c, t, g, unknown or other
  modified_base (284)..(284): a, c, t, g, unknown or other
  modified_base (290)..(290): a, c, t, g, unknown or other
  modified_base (321)..(321): a, c, t, g, unknown or other
  modified_base (451)..(451): a, c, t, g, unknown or other
  modified_base (456)..(456): a, c, t, g, unknown or other
  modified_base (510)..(510): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcacatctcctgcactgaaccagcagtgacgttggtattatactatgtctcngtacaacacaccagcaaagccccaatcatnatttangatgtacagtaatcggcctcgtagggtttcngtatcgcttctccgtggctcaagtcctagggacctaacgaccggtccctccctacgacctatctcgtcgggctccgaagcgtggaggacgaggtctagtaacttatactgccaggtctacatatgcacgnacgtntatgactctaagttacgttcggacggagaccgaagcgttcgaccgtcgtagtcncgaccgagtcgttcgccccg

SEQ ID NO: 364598 - DNA, 649 bp, Homo sapiens
  misc_feature: GZ8MTXP01C41ZN.45.70.G04.1.454.CMB.2.raw
  modified_base (221)..(221): a, c, t, g, unknown or other
  modified_base (298)..(298): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggaccagtctgccctgactcagcctgcctcgtgtctgggtctctggacaggcgatcacatctctgcatggaaccngcagtgacgttggttaattataactatgtctcctgtaaccaacaacaccagacaaacgccccaaatcatgtatttangtatagtctaagtaatccggcctgtagggttctgattcgcttctctggtctcgagtcgtacgacaaccgacgtccctacctacgaccctagttcgtcgttcgggccttaccgtaaggcgttacgggaacgggaccggtaacgggttacgttacgttaacgttaacgttacgtacgtacgtacggtactacgtaaagttacgtacgaccgtaacgcctaaacgtctaagttacgtacgtttacgttaacggttacgttacggggtacggaacggttaacgtaacggttcgttacggttacccggttcgtaacggccgtaaccgacccggttacgttcccgttccccgtcccg

SEQ ID NO: 364599 - DNA, 596 bp, Homo sapiens
  misc_feature: GZ8MTXP01BR09S.45.70.G04.1.454.CMB.2.raw
  modified_base (197)..(197): a, c, t, g, unknown or other
  modified_base (244)..(244): a, c, t, g, unknown or other
  modified_base (249)..(249): a, c, t, g, unknown or other
  modified_base (287)..(287): a, c, t, g, unknown or other
  modified_base (293)..(293): a, c, t, g, unknown or other
  modified_base (321)..(321): a, c, t, g, unknown or other
  modified_base (328)..(328): a, c, t, g, unknown or other
  modified_base (335)..(335): a, c, t, g, unknown or other
  modified_base (508)..(508): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacnggcatcaccatctcctgcactggaaccagcagtgacgttgttattanaactntgtctctggtaccacacaccagcaaagccccaatcatnatttangatgtcagtatcggcctcgagggtttcngactcgnttctccnggtctcgaagtctaggcaacgacggcctccctgacctattctctcgggtcctacgtaggcgtacgaggaccgtagggcttaggtatttaacgttactaggtcaaggggtccttactagtaacttcgccgtaacgcgacgctaagtcggtaccttcgttaacgtgttaccgggngggttaccgggacgtaacggcgttacggacccgtccgtaacgggttccaacgggtccccaaacggggttcccttcccggtaacccccg

SEQ ID NO: 364600 - DNA, 495 bp, Homo sapiens
  misc_feature: GZ8MTXP02GTMY7.45.70.G04.1.454.CMB.2.raw
  modified_base (427)..(427): a, c, t, g, unknown or other
tcagacgcgatcgacacgaccggtgctcgatttagtgtagtgtgaagggaaagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctcctggtaccaacaacacccaggcaaagcccccaaactcatgatttatgatgtcagtaatcggcctcaggggtttctgatcgcttctctggctccaagtctggcacacggcctccctgacccatctctgggctccaggctgaggacgaggctgattattactgcagctcattangcacgcagcatgactctagtattcggcggaggaccagctgaccgtctaggtcagcccaggctcgcccc

SEQ ID NO: 364601 - DNA, 551 bp, Homo sapiens
  misc_feature: GZ8MTXP02IZJAW.45.70.G04.1.454.CMB.2.raw
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggatccagcggtgacgttactgtttttaagatgtctcctggtatcagcaacacccaggcaaagcccccaaaactcatcatttatgatgtcaaataaatcggccctcgaggggtttctctatcgtcttcctctggctcaagtctgcaatacggcctcctgaccatctctggctcagctgaagcgagctgattatactgcagcaacataatattagtgtttcacgttcggtagttcggacggacgggtacctaaggttcgaaccgttcgtacggttaccgacggacccgtaaaggtccgtacgtcccccgtcggtacctccgtcgtttccccgg

SEQ ID NO: 364602 - DNA, 554 bp, Homo sapiens
  misc_feature: GZ8MTXP02INZ9C.45.70.G04.1.454.CMB.2.raw
  modified_base (265)..(265): a, c, t, g, unknown or other
  modified_base (299)..(299): a, c, t, g, unknown or other
  modified_base (328)..(328): a, c, t, g, unknown or other
  modified_base (354)..(354): a, c, t, g, unknown or other
  modified_base (422)..(422): a, c, t, g, unknown or other
tcagacgcgatcgacacgaccggtgctcgatttagtgtagtgtgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctctgtaccaanaacaccagacaaacgccccaaactcatgatttangatgtacagtatcggcctgtagggtttcngatcgcttctctgctcagtctgcacncgcctcctgaccatctctggctccgagctgagacgaggctagtaattatactgcagctacattagtcncacgacagactatagtacttagttacgttacggttacggggacgggtaaacgggaaccaacggtaccgtacggtacccgttaaccgtacggtaccgaaccggacccggaacggtcccgtacccggtcccccg

SEQ ID NO: 364603 - DNA, 630 bp, Homo sapiens
  misc_feature: GZ8MTXP02IMY0Q.45.70.G04.1.454.CMB.2.raw
  modified_base (248)..(248): a, c, t, g, unknown or other
  modified_base (295)..(295): a, c, t, g, unknown or other
  modified_base (444)..(444): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctcctgcactggaaccagcagtgacgttgtattataactntgtctctgtaccaacacaccagcaaacgccccaaatcatgtatttangtatgtacagtaactccggcctagtacgggtttcagtactcgtcttctccgtggtacctactaagttcgtacggacaccgccggtccctcccgtacgacctatcctcgtcggcctccgagtctaggacgacgagctagtattacttacngacagactaataattattatttaacgttcgtttacccgtacggttcgggttaacgttcggggacgggtaacggtaaccgtaacggtttccggtaccggttaccgtacggtaccgaaccggacccgtaacggtcccgtacccggacccccgttcggtacctccgtttaccgttcccgtttacccccc

SEQ ID NO: 364604 - DNA, 616 bp, Homo sapiens
  misc_feature: GZ8MTXP02F6EAT.45.70.G04.1.454.CMB.2.raw
  modified_base (290)..(290): a, c, t, g, unknown or other
  modified_base (301)..(301): a, c, t, g, unknown or other
  modified_base (484)..(484): a, c, t, g, unknown or other
  modified_base (490)..(490): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgtacgttgttattataactatgtctctgtaccaacaacaccagacaaacgccccaaancatagatttangatgtacaagtaacgtccggaccttcgtaggggtttctgtactcgtctttctccgtcgtcctacgtaacgtcgtacggaccaccgaccggtccctacccgtacgaccctactcctcgtcgggccctaccgacggtcgtaggaacggacgaggtcgttagtaatttactacgtgacacgtctanattacngaccacgacacgactagtagtacttacgtaaggttacggttcggggacggaaacgggtaaccacgtacgtaccggtaccgtaacgtacgaccgaaccgccgtaacggtcccgtcccggtacccccg

SEQ ID NO: 364605 - DNA, 527 bp, Homo sapiens
  misc_feature: GZ8MTXP02GN72I.45.70.G04.1.454.CMB.2.raw
  modified_base (298)..(298): a, c, t, g, unknown or other
  modified_base (418)..(418): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctctgtaccaacaacaccagcaaacgccccaaatcatgatttangatgtacagtaatcggcctcgagggtttctgatcgcttctctgctcagtctgacacgcgcctcctgaccatctctcggctccgagctgagacgagctagtattatactgctgctcattangacgtaggttagttagttacgtttggtcgttcgggcggaacgggaccaaggctggacccgtcgtacggtcacgcccgaacggtctccgccccgtggtcctacgttcccg

SEQ ID NO: 364606 - DNA, 566 bp, Homo sapiens
  misc_feature: GZ8MTXP02INIIZ.45.70.G04.1.454.CMB.2.raw
  modified_base (225)..(225): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcacatctcctgcactggaaccngcagtgtacgttgttattataactatgtctctgtaccacaacaccaggacaaacgcccccaaatcatgatttatgatgtcaagtaatcggccctgtaggggtttctgtatcgtcttctccgtcgtctacaacgttctcggacaccgacggccctcccacgaccatcctcgtcggcctcaggctaggacggacgaggtctagtatttatacgtgacagtcttacattacgtcgaccacggacagcctatagtacctacgtagttacgttcggggacgtacggggaacacgctaccggacccgtcgtacggtccacggacccgaacggtcctaccgtcccccg

SEQ ID NO: 364607 - DNA, 572 bp, Homo sapiens
  misc_feature: GZ8MTXP02HA1LR.45.70.G04.1.454.CMB.2.raw
  modified_base (250)..(250): a, c, t, g, unknown or other
  modified_base (282)..(282): a, c, t, g, unknown or other
  modified_base (301)..(301): a, c, t, g, unknown or other
  modified_base (387)..(387): a, c, t, g, unknown or other
  modified_base (556)..(556): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatcctcctgcactggaaccagcagtgacgttgttaatataactntgtctctggtaccaacaacaccaggacaaacnccccaaactcatgatttangatgacagtaacgtccggcctcgtagggtttctctatcgtcttctccgtcgtctcctaagtcgtgactactaccggcctcccgtanacctatctcgtgggccttccgaggctaggaacgacgagctagtacttataactgacacgactaatattatacttagtttcttaccgtaacgttgggtaacttcgggacggaaggtacctaaggtcgaccgtcgtacgtcgacgccgaaggtcctcgtccccgtcgtacncttccgtcgtcccccg

SEQ ID NO: 364608 - DNA, 506 bp, Homo sapiens
  misc_feature: GZ8MTXP02GXHXP.45.70.G04.1.454.CMB.2.raw
  modified_base (301)..(301): a, c, t, g, unknown or other
  modified_base (405)..(405): a, c, t, g, unknown or other
  modified_base (439)..(439): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttgttattataactatgtctctggtaccaacaacaccaggacaaacgccccaaactcatgatttangatgtacagtaatcggcctcgtaggggtttctgatcgtcttctcctgctcagtctcggcacgaccgcctccctgaccatctcgtggctcgaggctggaggacgnggctagtattatactgcagtctcatatgacacgnagcatgactcgtagtcgtggacggtaggacagctacgacgtcgtacgcgacgccagcctcgtccccg

SEQ ID NO: 364609 - DNA, 584 bp, Homo sapiens
  misc_feature: GZ8MTXP02FYQWG.45.70.G04.1.454.CMB.2.raw
  modified_base (263)..(263): a, c, t, g, unknown or other
  modified_base (300)..(300): a, c, t, g, unknown or other
  modified_base (305)..(305): a, c, t, g, unknown or other
  modified_base (340)..(340): a, c, t, g, unknown or other
  modified_base (373)..(373): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatgttggattataccttgctctggtaccaanagcaccaggacaaacgcccccaaactcatgatttagngaggnagtaacgcggccctgtaggggtttactaagtcgtnttctcgtcggctcaagtctgacaacgcgcctcngacatctctggctcgaggctggaggcgacgctgtaatttattaacgcgtcgtcgtactactaattacgtggacgacggggaccctagaccgtacggttggggttagttccggggacgggacgggtaccgtagggttcggtacccgttcgtacggtacacggtacccgaacggtcctccggcccccgttcggtacctaccgtcctttccccg

SEQ ID NO: 364610 - DNA, 592 bp, Homo sapiens
  misc_feature: GZ8MTXP02ILI39.45.70.G04.1.454.CMB.2.raw
tcagacgcgatcgacacgaccggtgctcgatttagtgtagtgtgaagggaaagggggggtctcaggaggcaacgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctctgtacaacacaccagcaagccccaaatcatgatttatgatgtcagtaactcggcctcgtagggtttcaatcgtcttctctcgcctaccagtctcggacaacgaccggccctcctagacctaacttcctcgtcggctccgagctggacggacgaggtctacggtatttacttaacgtcgcttgacttcattagtgacgtaggttacgttagtttacggtttgggtacggttcgggacgggacgggtactaacggtctacggaccgttacgtacggtcgaccgccgaacggtccgtccgtccccgttacggtcctaccgttccttccggttaccccc

SEQ ID NO: 364611 - DNA, 625 bp, Homo sapiens
  misc_feature: GZ8MTXP02GLS81.45.70.G04.1.454.CMB.2.raw
  modified_base (226)..(226): a, c, t, g, unknown or other
  modified_base (302)..(302): a, c, t, g, unknown or other
tcagacgcgatcgacacgaccggtgctcgatttagtgtagtgtgaagggaaagggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacaggcgatcaccatctcctgcacgtggaaccngcagtgtacgttgttaattataactatgtctctgtaaccaacacaccaggacaaacgccccaaatcatgtatttangtatgtactaagtaacgtccggtcccttacggtaggggtttctagtactcgtctttcgtccgtcgcctacgtaagtctacggaccaccgtccggcccttcccgtacgaccctacgtcgtaccggtcgggccctacccggaggtcctagggaacggacgtacggtcttagtaacttacgttaacgcgacgtaagtccttagattacgtcgacgacgacaggtacctagtacgtacttacgtacgtacggttcgggacgggtaacgacacgtccgtacgtaccgtaacgtacgacgtaccgaccgtacgtcccgtccgtaccccg

SEQ ID NO: 364612 - DNA, 659 bp, Homo sapiens
  misc_feature: GZ8MTXP02HBK2J.45.70.G04.1.454.CMB.2.raw
  modified_base (227)..(227): a, c, t, g, unknown or other
  modified_base (251)..(251): a, c, t, g, unknown or other
  modified_base (300)..(300): a, c, t, g, unknown or other
  modified_base (335)..(335): a, c, t, g, unknown or other
tcagacgcgatcgacacgaccggtgctcgatttagtgtagtgtgaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctcctgcactggaaccngcagtgtacgttgtattataactntgtctctagtaccaacacaccagacaaacgccccaaatcatgtatttangatgtacagtaacgtccggacctgtacgggtttcngtacttcgtctttctccgtcggtcctacgacgttcgtacggaccaccgccggtccccttaccgtacgtacctacttccgtcggtcgggcctacccggaggtcgtaggaacgggtacgacggtcgttaacggtaaatttacgtaccgtacggactaacggtacttacgtagttacgtccgaccgaccggacaacggtctaacgttacgtacttacgtacggttacggttcggggaaccgggtaacggaaccgtacggtccgtacggtaccccgtaaggtaccggtaccgacggtaacccgtacggtaccctacccggttcccccg

SEQ ID NO: 364613 - DNA, 685 bp, Homo sapiens
  misc_feature: GZ8MTXP02FIL2F.45.70.G04.1.454.CMB.2.raw
  modified_base (311)..(311): a, c, t, g, unknown or other
tcagacgcgatcgacacgaccggtgctcgatttagtgtagtgtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcatcaccatctctgcacgtggaaccagcagtgtacggttgttaattaataactatgtctcgtagtaaccaacaacacccaggaccaaacgaccccaaatcaatgtatttangtatgtactaagttaacgtccggccccttacgggtacggggtttctaggtactccgtcctttcgccgttcggcctacgtaagttcgtacggaccaaccgtccgggccccttacccgtacgtaccctacttccgttcgtcggtccttacccgacggtcgtagggaagggaaccgagggtcttaggttaactttaacgttcgtacggacaacgtctaacctattaacgcgaccaacgcgacgactactacgtactaacgttaacggttacggttaccggggaacggggaaaccgggaaaccgaacggtccgtaccggtacccggttaacgtacggtaaccgaccggacccgtaacggcccgtcccggtacccccgg

SEQ ID NO: 364614 - DNA, 624 bp, Homo sapiens
  misc_feature: GZ8MTXP02F76T4.45.70.G04.1.454.CMB.2.raw
  modified_base (208)..(208): a, c, t, g, unknown or other
  modified_base (226)..(226): a, c, t, g, unknown or other
  modified_base (287)..(287): a, c, t, g, unknown or other
  modified_base (292)..(292): a, c, t, g, unknown or other
  modified_base (352)..(352): a, c, t, g, unknown or other
tcagacgcgatcgacacgaccggtgctcgatttagtgtagtgtgaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccntctcctgcactggaaccngcagtgatggtggattatacttgtctctgtacacagcaccagacaaacgccccaaatcatnattangaggcagtagcgcctgtacggtttcaatcgtcttcctcgtcgctaccaagtctgccaacnccggtcctccctgaacatctcgtggacctcgaggctggacggacgtaggtctagtattagttacgtgcttacgtctacgtattacgtacggtacgtaagggttagttaacgtttacgttttcggggtcggtttacccggggagggtaaacggggtaccgtaaacggtccggttaccgggttaaacccgttccggttaacggttccgaaccggtaccccgtaaagggtcccccgtcccggtaccccccggttaccgggtaacctttcccccgg

SEQ ID NO: 364615 - DNA, 573 bp, Homo sapiens
  misc_feature: GZ8MTXP01DYRBG.44.38.D05.1.454.CMB.2.raw
  modified_base (319)..(319): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaaggccgattcaccatctccagagaacaacgccaagaacncgctgtatctgacaaatgaacagtctgagagccgaggacaacggctgtgtattactgtgacaaagaggccggtggcgggaggttcggggtagttgacatactactactacgtatggacgtcgggtggggaccgaagggaccgacgggtccaccgtcctcctcacgccttccaaccgaacgggcccacgtccggttcctttcccccgtcggcccgcccgttcgcctccgcggacgcgaccgtcgttcgggggccg

SEQ ID NO: 364616 - DNA, 562 bp, Homo sapiens
  misc_feature: GZ8MTXP01DYFWC.44.38.D05.1.454.CMB.2.raw
  modified_base (294)..(294): a, c, t, g, unknown or other
  modified_base (337)..(337): a, c, t, g, unknown or other
  modified_base (372)..(372): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaaggccattcaccatcncagagacaacgccaaagacacgctgtatctgacaaatgaaacngtctgagagccgaggacaacgggctgtgtattacngtgacaaggacgccggtgcgggaggtcggggagttgacatactactacgtacgtatggacgtcggtcggggacgaacgggaccgacggtcgaccgtctcctcacgctccaccgaacgggcccacgtccggttcctccccgtcgccgcccttcgcctccgaacggacgccgaccgtcgttcgggggaaccg

SEQ ID NO: 364617 - DNA, 521 bp, Homo sapiens
  misc_feature: GZ8MTXP01ECQD6.44.38.D05.1.454.CMB.2.raw
  modified_base (293)..(293): a, c, t, g, unknown or other
  modified_base (447)..(447): a, c, t, g, unknown or other
  modified_base (456)..(456): a, c, t, g, unknown or other
  modified_base (496)..(496): a, c, t, g, unknown or other
tcagacagtatatacacgaccggtgctcgatttagtatctgatagttcagcctgggggtccctgagactctcctgtgcagcctctggattcaccttcagtagctactggatgcactgggtccgccaagctccagggaagggctggtgtgggtctcacgtattaatagtgatgggatagcacaagctacgcggactccgtgaaggccattcaccatctccagagacaacgccaagaacacgctgtatctgacaaatgaacagtctgagagccgaggacacggctgtgtattacngtgcaagagccggtgcgggagttcgggattgcatactactactacgtatggacgtcgtggggccaaggggcccacggtcacgtctctcagctccaccaacggcccatccggtccttcccccgtcgccgccctcgcctcaggacgccgacctcgnggggcacgngccggcctgggctgccttggtcaaggctacttccttattntaactgtctgagcggtcgttgaacg

SEQ ID NO: 364618 - DNA, 532 bp, Homo sapiens
  misc_feature: GZ8MTXP01ATLG9.44.38.D05.1.454.CMB.2.raw
  modified_base (316)..(316): a, c, t, g, unknown or other
  modified_base (360)..(360): a, c, t, g, unknown or other
  modified_base (414)..(414): a, c, t, g, unknown or other
  modified_base (515)..(515): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaaagtaaaagtgtgcactggtaccagcagaagccaggccaggcccctgtgctggtcatctattatgatagcgaccggccctnagggactcccgtgagcgattctctggctcaactcgtagggaacncggccaccctgaccatcagcagggtcgaaggccggggatgaggccgactatacngtcaggtgtgggatagtagtgtgatcagtcggggttgtcgggcggagggaccaaggctggacccgtcgaggtcaagcccgaaggcctcgccccctggtccncttctccgttcccgtcc

SEQ ID NO: 364619 - DNA, 572 bp, Homo sapiens
  misc_feature: GZ8MTXP01AR5L2.44.38.D05.1.454.CMB.2.raw
  modified_base (339)..(339): a, c, t, g, unknown or other
  modified_base (380)..(380): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaaggccattcaccatctccagagacaacgccaaagaacacgctgtatctgacaaatgaaacngtctgagagccgaggacaacggctgtgtatactgtgcaagngccggtgcgggagttcgggagttgacagtactactacgtacgtatggacgtcggtcggggaccgaacgggaccgacggtccaccgtcctcctcacgccttccgaccgaacgggccccacgtccggttcccttcccccgtcggcccgcccgttcgcctcccgaacggacgccgacccgtcggttcgggggccg

SEQ ID NO: 364620 - DNA, 559 bp, Homo sapiens
  misc_feature: GZ8MTXP01BYMV0.44.38.D05.1.454.CMB.2.raw
  modified_base (334)..(334): a, c, t, g, unknown or other
  modified_base (370)..(370): a, c, t, g, unknown or other
  modified_base (378)..(378): a, c, t, g, unknown or other
  modified_base (401)..(401): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaagggctggtgtgggtctcacgtattaatagtgatgggatagcacaagctacgcggactccgtgaaggccattcaccatctccagagacaacgccaagaacacgctgtatctgcaaatgaacngtctagagagccgaggacaacgggctgtgtattacngtgcaagngccggtggcgggaggttcggggngttgcatactactactacgtagtggacgtcgggtggggccgaagggaccgacggtccaccgtctcctctacgctccaccaacgggcccacgtccggttccgttccccgtcggccgcccgttcgcctcccgaaggacgccgaccgtcgttcgggggccg

SEQ ID NO: 364621 - DNA, 574 bp, Homo sapiens
  misc_feature: GZ8MTXP01CTMRJ.44.38.D05.1.454.CMB.2.raw
  modified_base (265)..(265): a, c, t, g, unknown or other
  modified_base (355)..(355): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccattcacatctcagagacaacgccaaagaacacgctgtatctgacaaatgaacagtcngagacgccgaaggacacggctgtgtattactgtgacaaggaggccggtggcgggtaggttcgggggattgcatactacctacgtacggtntcggacgtcgtggggccaaagggcccacgggtccaccgtctcctcacgtctaccacgaacgggcccacgtccggtcccttccccgtcggccgtccctcgcctccgaggggacgcctaccgtcggcggggccacgacgccggccgtggctcgccgtgtacgaggtaccttacgttacctattacgttcgttgtcgtagcggcgggcgttggccgaaggcg

SEQ ID NO: 364622 - DNA, 566 bp, Homo sapiens
  misc_feature: GZ8MTXP01DQR54.44.38.D05.1.454.CMB.2.raw
  modified_base (442)..(442): a, c, t, g, unknown or other
  modified_base (462)..(462): a, c, t, g, unknown or other
tcagacagtatatacacgaccggtgctcgatttagtatctgatagttcagcctggggggtccctgagactctcctgtgcagcctctggattcaccttcagtagctactggatgcactgggtccgccaagctccgagggaaggggctggtgtgggtctcacgtattaatagtgatgggatagcacaagctacgcggactccgtgaaggccattcaccatctccagagacaacgccaaagaacacgctgtatctgacaaatgaacagtctgagagccgaggacacggctgtgtattactgtgacaaagacggccgggtggcggggtaggttcgggggattgactaattacctactacgtacggtatgggacgtcgtggggaccaaaggggaccacgggtcaccgtctcctcagctccaccacggcccagtccgtccttccccgngccgcctcgcctcgaggacncacctcgtcgggcacgcgccgcccgcggctcgccgttcggtacaaacggtaccttacttccgttattacttaacctgtctcggacggttcgggcgttcggaacg

SEQ ID NO: 364623 - DNA, 547 bp, Homo sapiens
  misc_feature: GZ8MTXP01DMT0C.44.38.D05.1.454.CMB.2.raw
  modified_base (267)..(267): a, c, t, g, unknown or other
  modified_base (298)..(298): a, c, t, g, unknown or other
  modified_base (399)..(399): a, c, t, g, unknown or other
  modified_base (401)..(401): a, c, t, g, unknown or other
  modified_base (426)..(426): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccgagggaaggggctggtgtgggtctcacgtattaatagtgatgggagtagcacaagctacgcggactcgtgaaggccattcacatctcagagacaacgccaaagaacacgctgtatctgacaaaatgaaacagtcngagagccgaaggacacggctgtgtaattacngtgcaaagagccgggtgcgggggtagttcgggggattgcataactactactaggtatgggacgtctgggggccaaaggggacccacggtcaccgtctcctnanctcacaggccatcgtctcccctgcnccctgctccaggggacgcaccgtcgtggggcacgacgccggcccgtggggccttcgccgtcggtcgaacggtacttacgttcctattacttacttgtctgaacgcgggcttggcgaaggcg

SEQ ID NO: 364624 - DNA, 546 bp, Homo sapiens
  misc_feature: GZ8MTXP01BEWAE.44.38.D05.1.454.CMB.2.raw
  modified_base (361)..(361): a, c, t, g, unknown or other
  modified_base (422)..(422): a, c, t, g, unknown or other
  modified_base (494)..(494): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaaagtaaaagtgtgcactggtaccagcagaagccaggccaggcccctgtgctggtcatctattatgatagcgaccggcctgagggatccctgagcgattctcctggctccgaactcgtagggaaccncggcccaccctgaccatcagcgagggtcgaaggccggggatggacggaccgactattacgngtcgagggtgtgggagtaggtagtagtgatcgagtcgggtgttcgggcggagggaccaaggctgaccgtcgnggtcacgcccgagggcctcgcccccgtggtcaccttcgtccgttcccgcccc

SEQ ID NO: 364625 - DNA, 586 bp, Homo sapiens
  misc_feature: GZ8MTXP01D2GGF.44.38.D05.1.454.CMB.2.raw
  modified_base (276)..(276): a, c, t, g, unknown or other
  modified_base (294)..(294): a, c, t, g, unknown or other
  modified_base (338)..(338): a, c, t, g, unknown or other
  modified_base (342)..(342): a, c, t, g, unknown or other
  modified_base (364)..(364): a, c, t, g, unknown or other
  modified_base (372)..(372): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggatagcacaagctacgcggactccgngaaggccattcaccatcnccagagacaacgccaaagacacgctgtatctgacaaatgaaacngtcngagagccgagacaacggctgtntattacgngtgacaagacgccggtggcgggaggttcggggagttgacatactacgtacgtacggtagtaggacgtcgggtcggggaccgaaacgggacccgacggtccgacccgtctcctcacgccttcccaccgaacgggcccacgtcccggttcccgttccccgtcggcccgcccgttcgcctccgaacggacgccgaccgtccggttcgggggaacccg

SEQ ID NO: 364626 - DNA, 562 bp, Homo sapiens
  misc_feature: GZ8MTXP01CN9YA.44.38.D05.1.454.CMB.2.raw
  modified_base (375)..(375): a, c, t, g, unknown or other
  modified_base (382)..(382): a, c, t, g, unknown or other
  modified_base (472)..(472): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactcgtgaaggccattcacatctccagagacaacgccaaagaacacgctgtatctgacaaatgaaacagtctgagagccgaggacaacgggctgtagtattactgtncgaaagngcggtgcgggaggttcggggagttgactatactacgtacgtacgtatggacgtcggtcggggcgaacggaccgacgtccgaccgtctccnctacgcctccaccaacggcccacgtccgttccgttcccccgtcggcccgcccttcgcctccgaacggacgccgaccgtcgttcggggccg

SEQ ID NO: 364627 - DNA, 560 bp, Homo sapiens
  misc_feature: GZ8MTXP01AT26L.44.38.D05.1.454.CMB.2.raw
tcagacagtatatacacgaccggtgctcgatttagtatctgatagctgggttttccttgttgctattttaaaaggtgtccagtgtgaggtgcagctggtggagtccggggaggcttagttcagcctgggggtccctgagactctcctgtgcagcctctggattcaccttcagtagctactggatgcactgggtccgccaagctccagggaagggctggtgtgggtctcacgtattaatagtgatgggatagcacaagctacgcggactccgtgaaggccgattcaccatctccagagacaacgccaagaacacgctgtatctgcaaatgaacagtctgagagccgaggacaacgggctgtgtattactgtgcaagagccggtgcgggagtcggggagttgcatactactacgtacgtatggacgtcggtcggggccgaacgggaccgacggtcgaccgtctccgtcacgcctccaccgaacggcccagtccggttccgttcccccgtcggcccgcccgttcgtccctccgaacggacgccgacccgtcgttcgggggccg

SEQ ID NO: 364628 - DNA, 572 bp, Homo sapiens
  misc_feature: GZ8MTXP01DEHIA.44.38.D05.1.454.CMB.2.raw
  modified_base (281)..(281): a, c, t, g, unknown or other
  modified_base (298)..(298): a, c, t, g, unknown or other
  modified_base (319)..(319): a, c, t, g, unknown or other
  modified_base (381)..(381): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagccgtggggggtccctgagactctcctgtgcagcctctggattcaccttcagtagctactggatgcacgtgggtccgccaagctccgaaggggaaggggctggtgtgggtctcacgttattaatagtgagtgggagtagcacaagctacgcggactcgngaaggccatcacatccncagagacaacgccaaagaacngctgtatctgacaaatgaaacagtctggagagccgaaggacaacgggctgtgtaattactgngacaaagcggccggtggcgggaggttcggggagttcggactagtaactacgtacgtacggtatcgggacgtcgggtcggggaccgaagggaccgacggtcaccgtctacctcacgtcctcccaccgaacgggcccagtccggttcctccccgtggccgcccttgcctccgaagcgcgacctcggcggggcc

SEQ ID NO: 364629 - DNA, 547 bp, Homo sapiens
  misc_feature: GZ8MTXP01DPWJG.44.38.D05.1.454.CMB.2.raw
  modified_base (249)..(249): a, c, t, g, unknown or other
  modified_base (354)..(354): a, c, t, g, unknown or other
  modified_base (376)..(376): a, c, t, g, unknown or other
  modified_base (392)..(392): a, c, t, g, unknown or other
  modified_base (424)..(424): a, c, t, g, unknown or other
  modified_base (523)..(523): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactgggtccnccaagctccaggggaaggggctggtgtgggtctcacgtattaaatagtgatgggatagcacaagctaacgcggactccgtgaagggccattcaccatctccaganaccaacgcaaagacacgctgtntctgacaaatgaaacngtctgagagccgagacacggctgtgtattacngtgacaagaggccggtggcgggagttcggggagttgcatactactactacggtatggacgttcgtggggccaaggggtccacgggttcaccgtctcccncgacgccttccaaccgaaggcccc

SEQ ID NO: 364630 - DNA, 581 bp, Homo sapiens
  misc_feature: GZ8MTXP01BJY27.44.38.D05.1.454.CMB.2.raw
  modified_base (288)..(288): a, c, t, g, unknown or other
  modified_base (293)..(293): a, c, t, g, unknown or other
  modified_base (332)..(332): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggatagcacaagctacgcgactcgtgaggcattcacatcncaganacacgcaagaacacgctgtatctgacaaatgaacagtcngagagccgaggacaacgggctgtgtattacgtgtgacaaggacgccgggtggcgggtaggtcggggagttgactatactacgtacgtacggtatggacgtcgggtcggggaccgaacgggacccgacggtccaccggtctccgtctacgtccttccgaccgaacgggccccttacgtcccggttcccgttccccgtcggcccgttcccgttcgccctccgaacggcgccgaccgtcggttcgggggccg

SEQ ID NO: 364631 - DNA, 434 bp, Homo sapiens
  misc_feature: GZ8MTXP01CGEY8.44.38.D05.1.454.CMB.2.raw
  modified_base (428)..(429): a, c, t, g, unknown or other
  modified_base (431)..(434): a, c, t, g, unknown or other
tcagacagtatatacacgaccggtgctcgatttagtatctgatagttgggtttgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagcttccaccaaggcccatcggtcttccccctggcgcccctgctccaggagcacctctcgggggcacgagcggccctgggctgcctggtcaaggctacttcctatatactgtctgagcgggctggcaaggcgcatagnngnnnn

SEQ ID NO: 364632 - DNA, 567 bp, Homo sapiens
  misc_feature: GZ8MTXP01B6URC.44.38.D05.1.454.CMB.2.raw
  modified_base (272)..(272): a, c, t, g, unknown or other
  modified_base (287)..(287): a, c, t, g, unknown or other
  modified_base (292)..(292): a, c, t, g, unknown or other
  modified_base (307)..(307): a, c, t, g, unknown or other
  modified_base (330)..(330): a, c, t, g, unknown or other
  modified_base (368)..(368): a, c, t, g, unknown or other
  modified_base (488)..(488): a, c, t, g, unknown or other
  modified_base (544)..(544): a, c, t, g, unknown or other
tcagacagtatatacacgaccggtgctcgatttagtatctgatagctgggttttccttgttgctattttaaaggtgtccagtgtgaggtgcagctggtggagtccggggaggcttagttcagccgtggggggtccctgagactctcctgtgcagcctctggattcaccttcagtagctactggatgcactgggtccgccaagctccgagggaagggctggtgtgggtctcagtattaatagtgatgggagtagcacaagctacgcgactcgngaaggcatcacatcncaganacaacgccaagaacncgctgtatctgacaaatgaaacngtctgagagccgagactaacgggctgtgtaatttacgngtagacgaagcggcggtggacgggtagggttcggggtagttgactaactacgtaacgtacgtacgtagtacggtacgtcggggtacggggaccgaacggaccgacgtccgaccgtctccncgacgtcctaccgaccgaacggccacgtccgttcccgtcccgtcgccgccgcgccncgaacgcgccaccgtcgcgggcg

SEQ ID NO: 364633 - DNA, 604 bp, Homo sapiens
  misc_feature: GZ8MTXP01DID16.44.38.D05.1.454.CMB.2.raw
  modified_base (249)..(249): a, c, t, g, unknown or other
  modified_base (354)..(354): a, c, t, g, unknown or other
  modified_base (508)..(508): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactgggtccnccaagctccagggaaggggctggtgtgggtctcacgtattaatagtgatgggagtagcacaagctacgcggactccgtagaagggccatttcacaatcaccaganaccaacgcaaagaaccacgctagtaatctagacaaatgaaacagtctagagacgccggagacacgggctgtgtatacgtgtgacaagacggggccggttgggaccggggtaaggtttccgggggaagttcgctaatacgtactacgtacgggtntaagggacgttcggtcggggacctaaaggggcccacgggttcaaccccggttctaccctcgtacggaccttcccgaaccgttaacggggtaacccc

SEQ ID NO: 364634 - DNA, 608 bp, Homo sapiens
  misc_feature: GZ8MTXP01BTKI7.44.38.D05.1.454.CMB.2.raw
  modified_base (267)..(267): a, c, t, g, unknown or other
  modified_base (285)..(285): a, c, t, g, unknown or other
  modified_base (296)..(296): a, c, t, g, unknown or other
  modified_base (304)..(304): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccattcaccatctccagagacaacgccaaagaacacgctgtatctgcaaatgaaacagtcngagagccgaggacacggntgtgtattacngtgcaagngccgggtgcgggagttcggggattgcatactacctagtacggtatggacgtcgtggggccaaaggggacccacgggtcacccggttctcctcacgcttcccaccgaacgggcccagtccggtcccttcccccgtcggcccgcccctcgcctcccgacggggacgtccgtacccgtcgtcgggggccaccgacggcccgggccccgtggggcctcggtcccgtgggtaccaaacgggtccttaaccgtttccctaacttacgttaccgttgtccttggaacggcgggcgttgggcgaacgggccg

SEQ ID NO: 364635 - DNA, 640 bp, Homo sapiens
  misc_feature: GZ8MTXP01DB3TF.44.38.D05.1.454.CMB.2.raw
  modified_base (375)..(375): a, c, t, g, unknown or other
  modified_base (615)..(615): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagcccaccctcagtgtcagtcggcccaggaaagacggccaggattaccgtgtagggggaaacaacattggaaagtaaagtgtgcactggtaccagcagagcagccaggccctgtgctggtcatctattatgatagccgaccggccctcgagggactcccgtgacgcgtattcctccgtcggcctcccgaactccgtaacggggaaccnccgggcccaaccccgtcgacccactcgaggcgaggggtcgaaacgggccgggggatacggacggaccgacttacttacgtgtcgagggttggtagggtagttaaggtaggtagtgtagtcgtagttcgggggttgttccgggggcgggtaacgggacccgaaaggccgttacgggttaccccggtccgttagggtccaccggacccgaacgggttcctcccggcccccgttcggtacccnccgttccgttccgttccccgtcccc

SEQ ID NO: 364636 - DNA, 764 bp, Homo sapiens
  misc_feature: GZ8MTXP01D0GFL.44.38.D05.1.454.CMB.2.raw
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccacctcagtgtcagtcggcccaaggaaagacggccaggattaccgtggtagggggaaacaacagttaggaaagtaaaagtgtgcactggtaccagcagaagccaggccaggcccctgtgctggtcatctattatgatagccgaccggccctcgagggactcccgtagacgcgtacttcctccgtggacctaccgaaacctcggtaacggggaaacccaacccggggacccctaaaccccgtcgaacccaactcgaacgggaccggtaaggggtacccgaaacgggaccgggggagtacgggaacgggacccggtaacttaagttaccgtggtacgtaggggttaggtaggggtaaggttaaggtaggttacggtaggtaattacggtaaggttccgggggttagggttaccggggtacgggggtaacggggaaccgtaaacgggtccgtacgggacccggttacccggttaacggggttaccgaacccgggttaaccccggaaaggggttccccgttccccgggtacccccccggttcggggttaaccccacccggtttccccgttccccggttttccccccggtaaccccccg

SEQ ID NO: 364637 - DNA, 592 bp, Homo sapiens
  misc_feature: GZ8MTXP01CK4I5.44.38.D05.1.454.CMB.2.raw
  modified_base (300)..(300): a, c, t, g, unknown or other
  modified_base (306)..(306): a, c, t, g, unknown or other
  modified_base (344)..(344): a, c, t, g, unknown or other
  modified_base (348)..(348): a, c, t, g, unknown or other
  modified_base (366)..(366): a, c, t, g, unknown or other
  modified_base (376)..(376): a, c, t, g, unknown or other
  modified_base (546)..(546): a, c, t, g, unknown or other
  modified_base (570)..(570): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagctccgaggggaaggggctgggtgtgggtctcacgttattaatagtgagtgggagtagcacaagctacgcggactccgtgaagggccattcacatcnccaganacaacgccaagaacacgctgtatctgacaaatgaaacngtcngagagccgaggacaacgntgtgtatcgngtgacaagcgccgggtgcggggtaggtcggggagttgacgtactactacgtacgtacggtagtcgggacggttcggtcgggggacccgaacgggtacccgacggttccaaccgttctcccgtcacgtccttacccgacgaacgggccccttagttccgcccgttccccgngcccgcccttgcctccgaacggcnccgaccgtccggttggggcccg

SEQ ID NO: 364638 - DNA, 584 bp, Homo sapiens
  misc_feature: GZ8MTXP01BWC4M.44.38.D05.1.454.CMB.2.raw
  modified_base (274)..(274): a, c, t, g, unknown or other
  modified_base (371)..(371): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaaggggctggtgtgggtctcacgtattaatagtgatgggatagcacaagctacgcggactcgngaaggcattcaccatctccagagacaacgccaagaacacgctgtatctgacaaatgaacagtctagagagccgaggacaacgggctgtgtattacgngtcgacaaagcgccggtggcggggtaggttcggggagttgactacgtactactacgtacgtagtggacgtcggtcggggaccgtaacgggaccgacggtccgaccgtcgtcctcgacgtccttccaaccgaacgggcccttacgtccggttcccgttccccgtcggcccgttcccttcgcctccgaacggcgccaccgtcggttcgggggccg

SEQ ID NO: 364639 - DNA, 648 bp, Homo sapiens
  misc_feature: GZ8MTXP01CNT5H.44.38.D05.1.454.CMB.2.raw
  modified_base (292)..(292): a, c, t, g, unknown or other
  modified_base (307)..(307): a, c, t, g, unknown or other
  modified_base (389)..(389): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtcggccccaaggaaagacggccaggattaccgtggtagggggaaacaacgagttaggaaagtaaaagtgtagcacgtggtaccagcagaagccaggccaggccctgngctggtcatctatangatacgccgaccggcctcgacgggactcccgtagacgcgtattctccgtcggactacccgaaacgtcgtaacggggaacccnccgggacccaacccgtgaacccagtaccgacgcgacggggtacgaacgggccggggatcgggacggaccgtaacttacgttacgtgtacgtagggtggtagggtaagttaggtagtagtagatcgtaggttcggggttacggtcgggacgggtacgggaccgaaggtcgtacggaccggttcgttacggtccgacggttacccgagggttccctcccggccccgttcggtccctacttccgttcccgttccccgtcccc

SEQ ID NO: 364640 - DNA, 525 bp, Homo sapiens
  misc_feature: GZ8MTXP01AQLHV.44.38.D05.1.454.CMB.2.raw
  modified_base (224)..(224): a, c, t, g, unknown or other
  modified_base (430)..(430): a, c, t, g, unknown or other
  modified_base (451)..(451): a, c, t, g, unknown or other
  modified_base (512)..(512): a, c, t, g, unknown or other
  modified_base (521)..(521): a, c, t, g, unknown or other
tcagacagtatatacacgaccggtgctcgatttagtatctgatagttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattcttagtcttaacttgtctctggtatcaacatcatccagtaaagcccccaaatcatcatctatgagcctataagaggccctcgaggggtttctaatcgcttccactgcctcaacgtccgcaacacggcctcctgacaatctctcgggctccaggctggaggacgaggctgattattattgttgcttcaaggttnttgttcgtcgctatactattntgtcgtgggaaggtcggactagttccgtaccgtcgttagcacgaacccacgaacccacccncttcgtccncgtc

SEQ ID NO: 364641 - DNA, 583 bp, Homo sapiens
  misc_feature: GZ8MTXP01BMIPL.44.38.D05.1.454.CMB.2.raw
  modified_base (306)..(306): a, c, t, g, unknown or other
  modified_base (331)..(331): a, c, t, g, unknown or other
  modified_base (337)..(337): a, c, t, g, unknown or other
  modified_base (378)..(378): a, c, t, g, unknown or other
  modified_base (505)..(505): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagcccaccctcagtgtcagtcggcccaggaaagacggccaggattaccgtggtaggggaaacaacagttaggaaagtaaaagtgtgcactggtaccagcagaagccaggccaggcccctgtcgcgtggtcatctattangatacgcgacccggcctcgacgggntcccgngacgcgtattctccgtggctaccaactcgtaacgggaaccnccggcccaccctcgaccatcgagcgacggggtacgaacgggccggggatggacggaccgtacgttattaccgtgtcgaggtggtggagtaggtagtagtgatcgagttcgggtgtcggcggaggacnggcgtcgaccgtcgaggtcacggcccgagggcctcccggtccccgtcggtacctccgttcttcccggttccccgtccc

SEQ ID NO: 364642 - DNA, 592 bp, Homo sapiens
  misc_feature: GZ8MTXP01EQD6E.44.38.D05.1.454.CMB.2.raw
  modified_base (174)..(174): a, c, t, g, unknown or other
  modified_base (275)..(275): a, c, t, g, unknown or other
  modified_base (291)..(291): a, c, t, g, unknown or other
  modified_base (369)..(369): a, c, t, g, unknown or other
  modified_base (564)..(564): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttnagtagctactggatgcactgggtccgcaagctccgagggagggctggtgtgggtctcagtattaatagtgagtgggatagcacaagctacgcggactcggngaaggcattcacatcncagacacaacgcaagaacacgctgtatctgacaaaatgaaacagtctagagagccgagacaacggctgtgtaattacngtagacaaagggtcggccgggtgcggggtagggtcggggtagttggactattaacgtactacgtacgtagtaggacggtcggggtggggaccgaacgggtaccgaacggtccgaccgtctccctcgacgtccttacccgaccgaacgggtcccacgtccggttcccttccccgtcgggccccgcccgttccgccnccgaacggcgccgaccgtcggcggggcg

SEQ ID NO: 364643 - DNA, 615 bp, Homo sapiens
  misc_feature: GZ8MTXP01DX0KC.44.38.D05.1.454.CMB.2.raw
  modified_base (294)..(294): a, c, t, g, unknown or other
  modified_base (337)..(337): a, c, t, g, unknown or other
  modified_base (586)..(586): a, c, t, g, unknown or other
tcagacagtatatacacgaccggtgctcgatttagtatctgatagctgggtttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgagtgggagtagcacaagctacgcggactccgtgaggccattcacatcncagagacaacgacaagaacacgctgtatctgacaaatgaaacngtctagagagccgagaccgaacgggctggtagttaattacgtgtagacgaagggacggtccgggtggcgggggtagggttcggggtagttcggactacgtaactacgtaacgtacggtagtcgggacggttcggggtacgggggaacccgaacggggacccgtacggtccctaccgtccgtccctcacgtcctacccaccgaacggcccttacgtcccggttccctccccgtggcccgttccgcgtccnccgaaggacgccaccgtcggcggggaacc

SEQ ID NO: 364644 - DNA, 656 bp, Homo sapiens
  misc_feature: GZ8MTXP01C6ILL.44.38.D05.1.454.CMB.2.raw
  modified_base (280)..(280): a, c, t, g, unknown or other
  modified_base (295)..(295): a, c, t, g, unknown or other
  modified_base (317)..(317): a, c, t, g, unknown or other
  modified_base (370)..(370): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagctccgaggggaggggctggtgtgggtctcacgttattaatagtgagtgggagtagcacaagctacggcggactcgngaaggcatcacatcncagacgacaacgccaaagaacncgctgtatctagacaaatgaaacagtctagagacgccgaggacaacggctgtntattactgtcgacagacggccgggtggcggggtaggttcgggggagttggactaacttacgtaacgtaacgttacgggtagtacgggtaccggttacggggtacgggggacccgaaacggggaccccgtacggtacccgtacccggttcctcccgttcgaccggtcccttacccgaacccgtaaaccgggccccttacggttcccggttcccttcccccgtcgggccccgttcccgttcgccctccgaacgggaccgccgttacccgtcgggttcgggggaacccg

SEQ ID NO: 364645 - DNA, 571 bp, Homo sapiens
  misc_feature: GZ8MTXP01E1THE.44.38.D05.1.454.CMB.2.raw
  modified_base (198)..(198): a, c, t, g, unknown or other
  modified_base (292)..(292): a, c, t, g, unknown or other
  modified_base (310)..(311): a, c, t, g, unknown or other
  modified_base (313)..(316): a, c, t, g, unknown or other
  modified_base (318)..(318): a, c, t, g, unknown or other
  modified_base (320)..(321): a, c, t, g, unknown or other
  modified_base (324)..(324): a, c, t, g, unknown or other
  modified_base (332)..(332): a, c, t, g, unknown or other
  modified_base (345)..(345): a, c, t, g, unknown or other
  modified_base (354)..(354): a, c, t, g, unknown or other
  modified_base (356)..(356): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcaggcctggggggtccctgagactctcctgtgcagcctctggattcaccttcagtagctactggatgcactgggtccncaagctccgagggaagggctggtgtgggtctcacgttattaatagtgatgggatagcacaagctacgcggactccgtgaacggccatcacatcnccagagacacgcaagacnntnnnnanannacngcacgagngacgagcgacgtntgtatatgngngacgagtcggtcggtagggcgggttaggtcggtatcgactaacttactacgtacggtcgtggcgaccgtcggggacggaccgaccggaccgtaccgtccctccgtcctaccgaccgtaccgtaccctacccgaaccggtcccgtcccttccggtccccgttcccgtccccgcgcccgttccgacgcccacggaacgccgccgcggtcgggcgccg

SEQ ID NO: 364646 - DNA, 576 bp, Homo sapiens
  misc_feature: GZ8MTXP01AM07M.44.38.D05.1.454.CMB.2.raw
  modified_base (301)..(301): a, c, t, g, unknown or other
  modified_base (337)..(337): a, c, t, g, unknown or other
  modified_base (371)..(371): a, c, t, g, unknown or other
  modified_base (476)..(476): a, c, t, g, unknown or other
  modified_base (488)..(488): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaagggccattcacatctccaganacaacgccaagacacgctgtatctgacaaatgaacngtctgagagccgaggacaacggctgtgtattacngtgcaaaggcgccggtggcgggaggttcggggagttgacatactactacgtacggtagtggacgtcggtcggggccgaacgggaccgacggtcgaccgtcgtccncgtacgtctccnccgaacgggcccacgttcccgttccgttcccccgtcggcccgcccttacgcctcccgaacggccgccgaccgtcggttcgggggcccg

SEQ ID NO: 364647 - DNA, 589 bp, Homo sapiens
  misc_feature: GZ8MTXP01A1OLW.44.38.D05.1.454.CMB.2.raw
  modified_base (293)..(293): a, c, t, g, unknown or other
  modified_base (334)..(334): a, c, t, g, unknown or other
  modified_base (369)..(369): a, c, t, g, unknown or other
tcagacagtatatacacgaccggtgctcgatttagtatctgatagctgggttttccttgttgctattttaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggatagcacaagctacgcggactccgtgaaggccgattcacatcncagagacaacgcaagaacacgctgtatctgacaaatgaacngtctcgagagccgagacaacgggctgtgtattacngtgcgaagagccggtgcgggtaggttcggggattgactagtactacgtacgtacggtagtggtaccgtcgggtacggggaccaaaggggtaccccacgggtccaccggttcctccgtcacgtccttacccgaccgtaacgggccccttagtcccggttccttcccccgtggcccgcccttggccctccgaacgcgccgttacccgtcgggttcggggccc

SEQ ID NO: 364648 - DNA, 578 bp, Homo sapiens
  misc_feature: GZ8MTXP01CAG2N.44.38.D05.1.454.CMB.2.raw
  modified_base (287)..(287): a, c, t, g, unknown or other
  modified_base (290)..(290): a, c, t, g, unknown or other
  modified_base (295)..(295): a, c, t, g, unknown or other
  modified_base (335)..(335): a, c, t, g, unknown or other
  modified_base (360)..(360): a, c, t, g, unknown or other
  modified_base (364)..(364): a, c, t, g, unknown or other
  modified_base (371)..(371): a, c, t, g, unknown or other
  modified_base (373)..(373): a, c, t, g, unknown or other
  modified_base (385)..(385): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccgagggaaggggctggtgtgggtctcacgtattaatagtgatgggatagcacaagctacgcgactcgtgaaggcatcacntcncaganacaacgccaaagaacacgctgtatctagacaaatgaaacngtctagagagccgagacaacgggtntgtntattcgngngacgagcgcggnggcgggtggtcgggtagtgactagtacgtacgtacgtacgtagtacggtacgtggggtacggggaccgaacgggaccgacgtccgtacccgtccgtcctcgtacgtcctaccgaccgaaccggccgttcgtcccgttcccgtccccgtcggcccgccgttcgcctccgaacggcgccgaccgtcggcgggccg

SEQ ID NO: 364649 - DNA, 676 bp, Homo sapiens
  misc_feature: GZ8MTXP01B61S7.44.38.D05.1.454.CMB.2.raw
  modified_base (305)..(305): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtcccgccaagctccgaggggaaggggctggtgtgggtctcacgtattaatagtgatggggatagcaacaagctacgcggactccggtagaacgggccgattcacatcnccagacgacaacgccaaagaacacgctgtactctagacaaatgaaacagtctagagagccgaggacaacgggctggtgtattacgtgtgacgaaaggcggccgggtggcgggtagggttcggggtagttggactaacgtactaacgtaacgtacggtagtacgggtaccggttcggggtcggggtaaccggaaacgggtacccgtacggtcccgtaacccggttcctacccgtcgtaccgtcccttacccgaacccgaaacggggtccccttacggttcccggttccccgtttacccccggtccggccccgttccccgttccgtcccctccgaacggaccgcccgttacccggtcggttcgggggaacccg

SEQ ID NO: 364650 - DNA, 575 bp, Homo sapiens
  misc_feature: GZ8MTXP01BJXYC.44.38.D05.1.454.CMB.2.raw
  modified_base (287)..(287): a, c, t, g, unknown or other
  modified_base (303)..(303): a, c, t, g, unknown or other
  modified_base (372)..(372): a, c, t, g, unknown or other
  modified_base (440)..(440): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattaccgtggtagggggaaacaacagttaggaaagtaaaagtgtgcactggtaccagcagagccaggccaggcccctgngctggtcatctattangatagcgaccggccctcgagggactcccgtgacgcgattcctcctggctccaactcgtaacgggaaccnccggcccacccgtcgacccataccgagccgagggtcgaaggccggggatggaggccgaactattacgngtcgaggtgtgggagtaggtagtagtgagtcagtcgggtagtcggcgggaggaccaaggctcgaccgtccaggtaccacgcccaggcctccggcccccgtcggtccacccgttcgttcccgttccccgtaacccc

SEQ ID NO: 364651 - DNA, 566 bp, Homo sapiens
  misc_feature: GZ8MTXP01EY8VF.44.38.D05.1.454.CMB.2.raw
  modified_base (276)..(276): a, c, t, g, unknown or other
  modified_base (295)..(295): a, c, t, g, unknown or other
tcagacagtatatacacgaccggtgctcgatttagtatctgatagctgggttttccttgttgctattttaaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactcgngaaggccgattcaccatcnccagagacaacgccaagaacacgctgtatctagacaaatgaaacagtctagagagccgaggacaacgggctgtgtattactgtgcaaagcgcggtgcgggaggtcgggagttgacatactactacgtacgtagtaggacgtcgggtcggggaccgaacgggaccgacggtccgaccgtcctcctcacgtcctccaccgaacggcccacgtccggttccgttccccgtcgccgcccttcgcctccgcggacgccgaccgtcgttcggggccg

SEQ ID NO: 364652 - DNA, 601 bp, Homo sapiens
  misc_feature: GZ8MTXP01B03O7.44.38.D05.1.454.CMB.2.raw
  modified_base (291)..(291): a, c, t, g, unknown or other
  modified_base (336)..(336): a, c, t, g, unknown or other
  modified_base (358)..(358): a, c, t, g, unknown or other
  modified_base (362)..(362): a, c, t, g, unknown or other
  modified_base (367)..(367): a, c, t, g, unknown or other
  modified_base (395)..(395): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccgagggagggctggtgtgggtctcacgtattaatgtgagtgggatagcacaagctacgcggactccgtgaaggcattcacatcncagagacaacgccaagacacgctagtactctagacaaatcgaacngtcaggagagcgagacaacggntgtntatcngtgcagcgcggtggcgggtaggtcgggngttgactatactacgtacgtacgtagtagggtacgtcggggtcggggaccgaacgggacccgtacggtccgacccgtcgtccctcgtacgtcctcccgaaccgtaaccgggccccttacgttccccggttcccgttcccccggtcgggttccccgttcccgttcggtccctccgaacggacgccgaccgtcgggttcggggaaccg

SEQ ID NO: 364653 - DNA, 582 bp, Homo sapiens
  misc_feature: GZ8MTXP01C6KTA.44.38.D05.1.454.CMB.2.raw
  modified_base (199)..(199): a, c, t, g, unknown or other
  modified_base (270)..(270): a, c, t, g, unknown or other
  modified_base (282)..(283): a, c, t, g, unknown or other
  modified_base (285)..(285): a, c, t, g, unknown or other
  modified_base (290)..(290): a, c, t, g, unknown or other
  modified_base (307)..(307): a, c, t, g, unknown or other
  modified_base (329)..(329): a, c, t, g, unknown or other
  modified_base (333)..(333): a, c, t, g, unknown or other
  modified_base (353)..(353): a, c, t, g, unknown or other
  modified_base (362)..(362): a, c, t, g, unknown or other
  modified_base (364)..(364): a, c, t, g, unknown or other
  modified_base (375)..(375): a, c, t, g, unknown or other
  modified_base (378)..(378): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccncaagctccgagggagggctggtgtgggtctcagtattaatgtgatgggatagcacaagctacgcgactcgngaaggcatcacnncncaganacaacgcaaagacacgntagtatctagacaaatgaaacngtcngagagccgagacaacgggtntgtatatgngnagaggcgcggnggngggtaggtggtagtcgactatactacgtacgtagtagtacggtacgtcggggtacggggaccggaaacgggaccgaccggtaccaccgtcctccgtcgtaccgtacctacccgaaccggaaccggtcccttacgttcccgttcccgtccccgtcggcccgttcccgttcgcctcgaacggacgccgttaccgtcggcgggaacg

SEQ ID NO: 364654 - DNA, 605 bp, Homo sapiens
  misc_feature: GZ8MTXP01BVUU9.44.38.D05.1.454.CMB.2.raw
  modified_base (265)..(265): a, c, t, g, unknown or other
  modified_base (354)..(354): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccattcaccatctccagagacaacgccaaagacacgctgtatctgcaaatgaacagtcngagagccgaggacacggctgtgtattactgtgcaagagccggtgcgggagttcggggattgcatactactactacggtatggacgtcgnggggcccaaagggacccacgggtccaccgttctccctcacgcttccaaccgaacgggccctacgtccggtcccttcccccgtcggccgtccccgtcgtcctcccgacggggacgccgtacccgtcgtcgggggccacgacgcccgggcccgtggggcctcgcccgtgggtcgaaacgggtaccttaccgttacctacttacttacgttcgtccgtggaacggtccggggcgttcgggaaccgaacgggccg

SEQ ID NO: 364655 - DNA, 670 bp, Homo sapiens
  misc_feature: GZ8MTXP01C4T0R.44.38.D05.1.454.CMB.2.raw
  modified_base (165)..(165): a, c, t, g, unknown or other
  modified_base (315)..(315): a, c, t, g, unknown or other
  modified_base (362)..(362): a, c, t, g, unknown or other
  modified_base (386)..(386): a, c, t, g, unknown or other
  modified_base (396)..(396): a, c, t, g, unknown or other
tcagacagtatatacacgaccggtgctcgatttagtatctgatagctgggttttccttgttgctattttaaaaggtgtccagtgtgaggtgcagctgggtggaggtccggggggaggcttagttcaggccgtgggggggtccctgagactctcctgtgcagcctntggattcaccttcagtagctactggatgcacgtgggtccgccaagctccgaaggggaaggggctgggtgtgggtctacaagttaattaatagtgagtgggagtagacacaaagctacggcggactccggtagaacgggccattcacatcncagagaacaacgccaaagaacacgctagtatctagacaaatgaaacngtcagagagccgtagacaacggtntgtatatagngagacgaaggcggcggtggacgggtaggtcgggtagttacgactaacgtaaccgtaacgtaacgtacggtagtacgggtacgtcgggggtacggggaaccgaaacgggacccgtaccggtcccacccgtcctaccgtacgtaccgtacccgtacccgaaccggtaaccggtcccgttaccggttccccggttccccgttccccggtcggccccgttcccgttccgtcccgaccggaacggtaccgtacccgttaccggtccgggccgggaaccg

SEQ ID NO: 364656 - DNA, 629 bp, Homo sapiens
  misc_feature: GZ8MTXP01CKAF1.44.38.D05.1.454.CMB.2.raw
  modified_base (223)..(223): a, c, t, g, unknown or other
  modified_base (247)..(247): a, c, t, g, unknown or other
  modified_base (303)..(303): a, c, t, g, unknown or other
  modified_base (401)..(401): a, c, t, g, unknown or other
  modified_base (449)..(449): a, c, t, g, unknown or other
  modified_base (576)..(576): a, c, t, g, unknown or other
tcagacagtatatacacgaccggtgctcgatttagtatctgatagttgggtttgggggaagaggaagactgacggtcctcccaggagttcaggtgctgggcaccttgggcacggggggaggtgtgtcacaagatttgggctctgggcacgtgggcagtgggggagcttagttcagccgtgggggtccctgagactctcctgtgcagcctctggattcaccttnagtagctatggatgcacgtggccncaagctcgaggggagggctggtgtgggtctcgagtataatgtgatgggatagcaanaagctacgcgactccgtagaacgggccattccaccatcaccagacgaaccaacgcaaagaacacgcttagtaatctagaactaaaatgaaacagttcnggaacgacgaccggaaggacctaacgggcttggtagtaactttaacgngtacgacgaagggcggggtccgggttggggacggggttagggttcggggtattcgactaaacgttaccgttaacgtaacgtagggtagtcgggtacgttcgggtacgggaccgaaacggggtacccncggttccaccgttctacctcgaaccgtccgttacccgaacggaacccggtccg

SEQ ID NO: 364657 - DNA, 595 bp, Homo sapiens
  misc_feature: GZ8MTXP01D35L7.44.38.D05.1.454.CMB.2.raw
  modified_base (295)..(295): a, c, t, g, unknown or other
  modified_base (300)..(300): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtccgccaagctccgaggggagggctggtgtgggtctcacgtattaatagtgagtgggagtagcacaagctacgcggactcgagaaggcattcacatcncaganacacgcaagacacgctgtatctagacaaatgaacagtctaggagagcccggaaggaccaacgggtcttggtagttaattacgtggtacgacgaaaggcggccgggtggcggggtaggtcggggagttgacgtatactacgtacgtacggtagtcggacgtcggggtcggggaccgaaacgggaccgacggtccgaccgtccgtcctctcgtcctaccgaccgaacggcccacgtcccggttccgttccccgtggcccgccttcgcctcgaacggcgccaccgtcggcggggaacc

SEQ ID NO: 364658 - DNA, 609 bp, Homo sapiens
  misc_feature: GZ8MTXP01AZVF3.44.38.D05.1.454.CMB.2.raw
  modified_base (251)..(251): a, c, t, g, unknown or other
  modified_base (311)..(311): a, c, t, g, unknown or other
  modified_base (408)..(408): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcagtgggggaggcttagttcagccgtggggggtccctgagactctcctgtgcagcctctggattcaccttcagtagctactggatgcacgtggtccncaagctcgaggggagggctggtgtgggtctcacgtattaagtagtgagtgggagtagcanaagctacggcggactccggtagaacgggcctattcgacttatcctccgagacgaacccacgacaaagaacacgtctgtaatctagacaaagtgaacngtctagagacggccgaaggacacggctgtagttattactggtacacgaaggcggggcgggtgggccgggtagggttcggggagttcgactagttactacgtacgtacggtgtcgggtacgttgggtcggggaccgaaggggtacccaccggttccaccggtcctcctcgacgtccgttacccgaaccgttaacgggtcccc

SEQ ID NO: 364659 - DNA, 625 bp, Homo sapiens
  misc_feature: GZ8MTXP01AXENN.44.38.D05.1.454.CMB.2.raw
  modified_base (252)..(252): a, c, t, g, unknown or other
  modified_base (443)..(443): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcagtgggggaggcttagttcagccgtggggggtccctgagactctcctgtgcagcctctggattccaccttcagtagctactggatgcacgtggtccncaagctccgaggggagggctggtgtggtctcacgtattaagagtgagtgggatagcacgaagctacgcggactccgaggacgggccattccaccatcaccagacgaccccaacgacaagaacacgtctagtaactctagacaaatgaaacagtctagagacgacggagaccacggcttgtacttaattcgngtagacgaagggacggggcccggggtgggccggggtaaggtttcgggggaagttgaccttaaacgttacgtaaccgtaacgtcgggtatcgggtaacggttcggtacggggaccgtaaacggggcccttaacgggttccacccgtctcccgtcaccgtccttacccgaaccgaagggtcccc

SEQ ID NO: 364660 - DNA, 606 bp, Homo sapiens
  misc_feature: GZ8MTXP01B6SGS.44.38.D05.1.454.CMB.2.raw
  modified_base (298)..(298): a, c, t, g, unknown or other
  modified_base (303)..(303): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggaaggggctgggtgtgggtctcacgtattaatagtgagtgggatagcaacaagctacggcggactccgtgaaggcatcacatcncaganacaacgaccaagaacacgctgtatctagacaaatgaaacagtctaggaaggacgccgaaggaccaacgggtcttggtagttaacttacgtgtacgacgaaaggcggccgggtgggacggggtagggttcggggagttgactacgtactacgtacgtacgtagtaggacgttcggggtcggggaccgaacggaccgacgtccaccgtctcctcacgtcctccaacgaacgggcccttacgtccgttcccgttccccgcggcccgcccttcgcctccgaaggcgccgaccgtcgggttcgggccg

SEQ ID NO: 364661 - DNA, 631 bp, Homo sapiens
  misc_feature: GZ8MTXP01ARC34.44.38.D05.1.454.CMB.2.raw
  modified_base (273)..(273): a, c, t, g, unknown or other
  modified_base (287)..(287): a, c, t, g, unknown or other
  modified_base (292)..(292): a, c, t, g, unknown or other
  modified_base (328)..(328): a, c, t, g, unknown or other
  modified_base (332)..(332): a, c, t, g, unknown or other
  modified_base (361)..(361): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagctccgagggagggctggtgtggtctcacgtattaatagtgagtgggatagcacaagctacgcgactcgngaggcatcacatcncaganacaacgccaagacacgctgtatctgacaaatgaacngtcngagcgccgagacaacgctgtgtattacgngtgacgaaggacggccgggtggcgggtaggttcggggtagttgacatactacgtaacgtacggtagtacgggtacggtcggggtacggggaccgtaacgggacccgtaaccgggtccgtacccggtccttacccgtaccgtacggtacccttacccgaacccggtaaccgggccccgttacggttcccggttccccgttcccccgtcggccccgttcccgttcgccccgtccgaacggcgcccgttaccgtccgggttcgggggaacccg

SEQ ID NO: 364662 - DNA, 635 bp, Homo sapiens
  misc_feature: GZ8MTXP01DX1KC.44.38.D05.1.454.CMB.2.raw
  modified_base (197)..(197): a, c, t, g, unknown or other
  modified_base (286)..(286): a, c, t, g, unknown or other
  modified_base (289)..(289): a, c, t, g, unknown or other
  modified_base (295)..(295): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccnccaagctccgagggagggctggtgtgggtctcacgtattaatagtgagtgggatagcacaagctacgcggactcgtgaaggcattcacntcnccaganacaacgccaaagacacgctgtactctgacaaatcgaacagtctgacgagcccggagacaacggctgtagtaacttacgtgtacgcgaaaggcggcccgggtgggcggggtagggttcggggtaggttcgacgtacgttactaacgttacgttaacggtagtagggtaccggttcggggtacggggaccgaaacgggacccgtaccggtcccgtaccgtcctacccgtcacgtaccgttacccgaaccgaaaccggcccgttcgtcccgggttccccttcccccgtcggttcccgcccttcgccctccgaacggacgccgacgtccggttcgggggaaccg

SEQ ID NO: 364663 - DNA, 639 bp, Homo sapiens
  misc_feature: GZ8MTXP01EOEH0.44.38.D05.1.454.CMB.2.raw
  modified_base (276)..(276): a, c, t, g, unknown or other
  modified_base (292)..(292): a, c, t, g, unknown or other
  modified_base (341)..(341): a, c, t, g, unknown or other
tcagacagtatatacacgaccggtgctcgatttagtatctgatagctgggttttccttgttgctattttaaaaggtgtccagtgtgaggtgtagctggtggagtccgggggaggcttagttcagccgtggggggtccctgagactctcctgtgcagcctctggattcaccttcagtagctactggatgcactgggtccgcaagctccgaggggaagggctggtgtgggtctcacgttattaatagtgagtgggatagcacaagctacgcgactcgngaaggccatcacatcncagacgacaaacgccaagaacacgctagtatctgactaaaagtgaaacngtctagaacgacggaccgaggtacacggtctagttgttaattacgtgtgacgaaggcgtcccgggtggcggggtagggttcggggagttgactaattacttaactaacgtacgggtatcgggaacgtcggtacggggggaccgaaacggggtacccaacgggtccacccgttcctccgtacgacgtccttacccgaaccgaacgggtccctaacgttcccggttcccgttcccccgtggccccttcccgttccgccgtccgacggaacgcccgaccgttccggtcgggggccaaccgg

SEQ ID NO: 364664 - DNA, 567 bp, Homo sapiens
  misc_feature: GZ8MTXP01AMHEG.44.38.D05.1.454.CMB.2.raw
  modified_base (198)..(198): a, c, t, g, unknown or other
  modified_base (240)..(240): a, c, t, g, unknown or other
  modified_base (284)..(284): a, c, t, g, unknown or other
  modified_base (286)..(286): a, c, t, g, unknown or other
  modified_base (289)..(289): a, c, t, g, unknown or other
  modified_base (304)..(304): a, c, t, g, unknown or other
  modified_base (322)..(322): a, c, t, g, unknown or other
  modified_base (327)..(327): a, c, t, g, unknown or other
  modified_base (549)..(549): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccctggggggtccctgagactctcctgtgcagcctctggattcaccttcagtagctactggatgcactggtccnccaagctccagggaagggctggtgtgggtctcacgtattaanagtgatgggatagcacaagctacgcgactcgtgaggcatcacancncangacaacgccaagacncgctgtatctgacaaatnaaacngtctgagagccgagacaacggtctgtgtattacgtgtgacaaagcgccggtggcgggtaggttcggggagttggacagttactacgtacgtacgtagtggacgtcgggtcggggaccgaagggacccgaccggtccgaccgtctcctcgtacgtccttccaccgaacgggcccttacgtccggttccttccccgtggcccgcccttcgcctccgaacggacnccgaccgtcgcggggccg

SEQ ID NO: 364665 - DNA, 673 bp, Homo sapiens
  misc_feature: GZ8MTXP01BR2EK.44.38.D05.1.454.CMB.2.raw
  modified_base (296)..(296): a, c, t, g, unknown or other
  modified_base (302)..(302): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtggtccgccaagctccgagggagggctggtgtgggtctcacgtattaatagtgagtgggatagacacgaagcgtacgcggactccgtagaaggccattcacatcnccaganacacgcaagacacgctgtatctagacaaagtgaacagtctaggagacggccggaaggaccaaacgggtcttggtagttacttacgtgtagacgaaagggcggtccgggtgcgggggtagttacgggggatttggactacgttactacgtaacgttacggtagtacgggtaccgtacgggggttcggggaacccggaacggggtacccgtaccgggttcccgaccccggtttcctacccgtaccaaccggttccttaccccgaacccggtaaacgggccccttagttccccgggttcccttccccccggtgccccggttccccttacggcccttaccgcggacgcccgttaccgttcggggcggggaacccg

SEQ ID NO: 364666 - DNA, 555 bp, Homo sapiens
  misc_feature: GZ8MTXP01CICIK.44.38.D05.1.454.CMB.2.raw
  modified_base (338)..(338): a, c, t, g, unknown or other
  modified_base (473)..(473): a, c, t, g, unknown or other
  modified_base (512)..(512): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccagggaagggctggtgtgggtctcacgtattaatagtgatgggatagcacaagctacgcggactccgtgaagggccgattcaccatctccagagacaaacgccaaagaacacgctgtatctgcaaatgaaacngtctgagagccgaggacaacgggctgtgtaattactgtgcaaagagccggtgcgggagtcggggagttgcatactactactacgtatggacgtcggtggggaccgaagggacccgacggtccgaccgtctcctcncgcttccaccaaacgggcccagtccggttctttcccccnggccgcccttcgctcccgaaggacgcgaccgtcgcgggggccg

SEQ ID NO: 364667 - DNA, 660 bp, Homo sapiens
  misc_feature: GZ8MTXP01BOP67.44.38.D05.1.454.CMB.2.raw
  modified_base (386)..(386): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtccgccaagctccgagggagggctggtgtgggtctcagtattaatagtgagtgggagtagcacaagctacggcggactccggtgaacggccgattccacatctccagacgacaacgccaagaacacgctgtatctagacaaatgaacagtctagaggacgcgaggacgaacgggctggtgtaattacgngtacgacgaaaggcgggcggtgggcggggtagggttggggtagttgacgtattactaacgtacgtacgggtaagtcgggtacgttcgggggtacggggtacccggaacggggaccccgtaccggtacccgtaccggtcccttcccgtccgtaccgtacccgttacccgaacccggaaccgggccccgttacgttcccggttccccgttcccccgtcggccccgttcccgttcgtcctccgaacggcgaccgttcccgtcggttcgggggaaccg

SEQ ID NO: 364668 - DNA, 570 bp, Homo sapiens
  misc_feature: GZ8MTXP01AMGUH.44.38.D05.1.454.CMB.2.raw
  modified_base (343)..(343): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaagggccattcaccatctcagagacaacgccaagaacacgctgtactctagcaaatgaaacagtcngagagccgaggacaacggctgtgtattactgtgacaaaggcgaccggtggcggggaggttcggggagttgactatactacgtactacggtagtggacgtcgggtggggaccgaagggacccgacggtccgaccgtcctcctcgacgctccaccgaacggcccagtccggttccgtccccgtcggcccgcccgttcgcctccgcggcgccaccgtcgttcgggggccg

SEQ ID NO: 364669 - DNA, 604 bp, Homo sapiens
  misc_feature: GZ8MTXP01AQO3Q.44.38.D05.1.454.CMB.2.raw
  modified_base (291)..(291): a, c, t, g, unknown or other
  modified_base (308)..(308): a, c, t, g, unknown or other
  modified_base (330)..(330): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctcgagggagggctggtgtgggtctcacgtattaatagtgagtgggatagcacaagctacgcgactcgtagacggccatcacatcncagacacacgcaagacncgctgtatctgacaaatgaacngtctagaggagaccggagacaacgggctggttagtattacgtgtagacaagggcgccgggtggcggggtaggttcggggagttgactatactacgtacgttacggtagtggacgtcggggtagggaccgaacgggtacccgtacggtccgtacccgtcctacctcgtcgtacctcccgaaccggaaccgggcccttacgtcccggttcccgttccccggtcggcccgttcccgcgtccgtccgaacggtaccgccgaccgttcggcggggaacc

SEQ ID NO: 364670 - DNA, 515 bp, Homo sapiens
  misc_feature: GZ8MTXP01D9MTN.44.38.D05.1.454.CMB.2.raw
  modified_base (355)..(355): a, c, t, g, unknown or other
  modified_base (397)..(397): a, c, t, g, unknown or other
  modified_base (399)..(399): a, c, t, g, unknown or other
  modified_base (422)..(422): a, c, t, g, unknown or other
  modified_base (425)..(425): a, c, t, g, unknown or other
  modified_base (434)..(434): a, c, t, g, unknown or other
  modified_base (438)..(438): a, c, t, g, unknown or other
  modified_base (486)..(486): a, c, t, g, unknown or other
  modified_base (502)..(502): a, c, t, g, unknown or other
tcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggatagcacaagctacgcggactccgtgaagggccattcaccatctcagagacaacgccaaagaacacgctgtatctgacaaatgaacagtctgagagccgaggacacggctgtgtatttactgtgacaagagcccgggttggcggggagttcggggattgctatacctactactacggtntcgggacgttcgtggggccaaaggggcccaggtcacgtctcncngctccacaggccatcgtctcccngcncctgcgtcngacncactcgtgggcacgcgcgcctggctgcttggtcaggactacttccttnttactaactgtctggnggcggtcgttgcg

SEQ ID NO: 364671 - DNA, 619 bp, Homo sapiens
  misc_feature: GZ8MTXP01C6Z86.44.38.D05.1.454.CMB.2.raw
  modified_base (291)..(291): a, c, t, g, unknown or other
  modified_base (379)..(379): a, c, t, g, unknown or other
  modified_base (570)..(570): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagcccaccctcagtgtcagtcggccccaaggaaagacggccaggattaccgtggtagggggaaacaacattaggaaagtaaaagtgtgacactggtaccagcagaagccaggccaggcccctgngctggtcatctatatgatagcgaccggcctgacgggactcccgtgacgcgtattcgtccgtggctccaactccgtaacggggaaaccnccgggacccacccgtgacccgatcgacgacgacggggtacgaacggccgggggatgggaacggccgtaacgttagttaccgtagtcgtaagggtggtagggaagttaggtaggttaggtgagtcgtagtcggggtaggttcggcgggtacgggaccaaggtcgtcggacccgtcgaggtaccgcgacccgnggccgttccggcccccttggtcccacgttccgttccgttccccgtcccg

SEQ ID NO: 364672 - DNA, 629 bp, Homo sapiens
  misc_feature: GZ8MTXP01BF4J5.44.38.D05.1.454.CMB.2.raw
  modified_base (313)..(313): a, c, t, g, unknown or other
  modified_base (368)..(368): a, c, t, g, unknown or other
tcagacagtatatacacgaccggtgctcgatttagtatctgatagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaaggccattcaccatctccagagacaacgccaaagaacacgctgtatctgacaaatgaaacagtctagagacgccggaggaccacggctgtgtattactgtgacaaggnggtccgggtggcgggggtaggttcgggggattgactatacctactacgtacggtntcgggacgtcggtggggacccaaggggacccgtacggtccaccgttctcctcgacgtcctacccaaccgaacgggcccctacgttccggtcccttcccccgtcggcccgcccgtcgccgtccgaggaccgccgtacccgtcggtcgggggaccaccggacggcccgggtccccggtacgggccgtccggtccgttacgggtaccgttaacggtaccttaccttccttagttactaacgtgtctggcgcgggcgttggaacg

SEQ ID NO: 364673 - DNA, 590 bp, Homo sapiens
  misc_feature: GZ8MTXP01BXZAC.44.38.D05.1.454.CMB.2.raw
  modified_base (274)..(274): a, c, t, g, unknown or other
  modified_base (285)..(285): a, c, t, g, unknown or other
  modified_base (288)..(288): a, c, t, g, unknown or other
  modified_base (316)..(316): a, c, t, g, unknown or other
  modified_base (329)..(329): a, c, t, g, unknown or other
  modified_base (368)..(368): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgagggagggctggtgtgggtctcacgtattaatgtgatgggatagcacaagctacgcggactcgngaggcatcacntcncagagacaacgcaagacacgctgtatcngacaaatgaaacngtctgagagccggaggaccacgggctggtgtaattacgnggtgacgaaaggcggccggtgggcggggtagggttcggggtagttgacgtattacgtacgtacgtacggtagtagggtacggtcggggtcggggccggaacgggaccgacggtccaccgtctcctcgtcgtcctccgaccgaacggcccacgtcccggttccgttccccgtcggcccgcccgttcgccgtccgaacggcgccgaccgtccggttcggggccg

SEQ ID NO: 364674 - DNA, 594 bp, Homo sapiens
  misc_feature: GZ8MTXP01D9Z20.44.38.D05.1.454.CMB.2.raw
  modified_base (297)..(297): a, c, t, g, unknown or other
  modified_base (327)..(327): a, c, t, g, unknown or other
  modified_base (570)..(570): a, c, t, g, unknown or other
  modified_base (573)..(573): a, c, t, g, unknown or other
  modified_base (577)..(577): a, c, t, g, unknown or other
  modified_base (579)..(579): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgagtgggagtagcacaagctacgcggactccgtgaacggccattcaccatcncagagacaacgccaaagacacgctgtatcngacaaatgaaacagtctaggagagcccgaaggtaccaacgggctgtagtacttactggtcgacgaagacggccgggtaggcggggtaggtcggggagttgactaattaactaccgtaacgtacggtagtacgggacgttcggggtacggggacccgaaggggacccacggtccacccgtctacctcgacgtcctaccacgaacggcccttagtcccggttcctccccgtgccgcccttcgccncgngacncnccgtcggaacgggcc

SEQ ID NO: 364675 - DNA, 606 bp, Homo sapiens
  misc_feature: GZ8MTXP01B24U4.44.38.D05.1.454.CMB.2.raw
  modified_base (382)..(382): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccgagggagggctggtgtgggtctcacgttattaatagtgagtgggatagcacaagctacggcggactccggtgaacgggccattcaccatcctccagacgacaacgccaaagaacacgctgtatctagacaaatgaacagtctagagagccgaggacaacggctgtgtattacgngtgacgaaggacggccgggtggcggggtaggttcggggagttgactatactactacgtacgtagtacggacgtcgggtcggggtaccgaacgggaccgacggtccgaccgtcctcctcgcgtcctcccaccgaacgggtcccttacgtcccggttcccgttccccgtggccccgttcccgttacgccgtccgaacggacgccacccgtcggttcggggaacccg

SEQ ID NO: 364676 - DNA, 722 bp, Homo sapiens
  misc_feature: GZ8MTXP01C7O51.44.38.D05.1.454.CMB.2.raw
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagcccaccctcagtgtcagtcggccccaaggaaacgacggccaggtacttaccgtggtagggggaaaacaacaagttaggaaagtaaaagtgtagcacgtggtaccagcagaacgccaggccaggcccctgtgctggtcatctattatgatacgccgaccggccctcgacgggtactcccgtgacgtcgtatttccgtacccgtccggtacctaccgtaacgtcggtaaacccgggaaccgcccggaccctacccgacgtaccacgacgacggacgggacgggtacggaacggggacgggagtacgggacccggacgttaacgtttacgttacgtcgtacgggtagggttagggtaagggttagggttaagggtagggttaaggtagtacgtacgggttcggggttcggggttacgggttccggggacggggtaaccggaaccgtaacggtccggtaccggttacccggttacggttaccggtaccgaccggaacccggcgttcccgtccccggtacccgtcggtacctccgttccgtttcccgttcccgtttcc

SEQ ID NO: 364677 - DNA, 613 bp, Homo sapiens
  misc_feature: GZ8MTXP01BD4TJ.44.38.D05.1.454.CMB.2.raw
  modified_base (250)..(250): a, c, t, g, unknown or other
  modified_base (351)..(351): a, c, t, g, unknown or other
  modified_base (373)..(373): a, c, t, g, unknown or other
  modified_base (383)..(383): a, c, t, g, unknown or other
  modified_base (398)..(398): a, c, t, g, unknown or other
  modified_base (402)..(402): a, c, t, g, unknown or other
  modified_base (422)..(422): a, c, t, g, unknown or other
  modified_base (434)..(434): a, c, t, g, unknown or other
tcagacagtatatacacgaccggtgctcgatttagtatctgatagttgggtttggggggaagaggaagactgacggtcctcccaggagttcaggtgctgggcaccttgggcacgggggaggtgtgtcacaagatttgggctctgggcaccgtgggcatgggggaggcttagttcagccgtggggggtccctgagactctcctgtgcagcctctggattcaccttcagtagctactggatgcactggtccncaagctccgaggggaaggggctgggtgtgggtctcacgtattaatgtgagtgggagtagcacgaagctacgcggactcgtggaacggccgattcgacatcncagagacccaacgacaagaacncgactgtaanctgacaaatgaaacngtcngagagccggagacgacggtntgtagtatacgngtagagaaggcggggcgggtggggacggggtagggttcgggagttcgactaacgtaaccgttaacgtacgtacggtagtcgggtacgttcgggtacggggaacccgtaacggggtacccttaccggttccacccgtcctccgtaaccgtacgtcccttaccgaacccgaacggtccccg

SEQ ID NO: 364678 - DNA, 578 bp, Homo sapiens
  misc_feature: GZ8MTXP01BS1LD.44.38.D05.1.454.CMB.2.raw
  modified_base (251)..(251): a, c, t, g, unknown or other
  modified_base (339)..(339): a, c, t, g, unknown or other
  modified_base (342)..(342): a, c, t, g, unknown or other
  modified_base (362)..(362): a, c, t, g, unknown or other
  modified_base (368)..(368): a, c, t, g, unknown or other
  modified_base (383)..(383): a, c, t, g, unknown or other
  modified_base (405)..(405): a, c, t, g, unknown or other
  modified_base (409)..(409): a, c, t, g, unknown or other
  modified_base (418)..(418): a, c, t, g, unknown or other
  modified_base (550)..(550): a, c, t, g, unknown or other
tcagacagtatatacacgaccggtgctcgatttagtatctgatagttgggtttggggggaagaggaagactgacggtcctcccaggagttcaggtgctgggcaccttgggcacgggggaggcgtgtcacaagatttgggctctgggcaccgtgggcagtgggggagcttagttcagccgtggggggtccctgagactctcctgtgcagcctctggattcaccttcagtagctactggatgcacgtggtccncaagctcgaggggagggctggtgtggtctcagtattaatgtgagtgggatagcagaagctacggcggactcgtagaaggcctatcacntcnccagacaccaacgcaagacncgctgntcagacaaatgaacngtcagagacgacgagacacgtntgtntacttacgngtacgacgaaggcggggtcggtgggcggggtaggttcgggatcgactaactaacgtacgtaacgtacggtgtaacggtcggttcggacgggaccgaacgggccttacggttcccttacccgtcctcccgtcncgtacccttaccgaaccgaacggtcccc

SEQ ID NO: 364679 - DNA, 582 bp, Homo sapiens
  misc_feature: GZ8MTXP01DKPLV.44.38.D05.1.454.CMB.2.raw
  modified_base (356)..(356): a, c, t, g, unknown or other
  modified_base (359)..(359): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctgggctcaccgtcagcagcaactacatgagttggtccgcaggctccgagggagggctgggagtgggtctcagtcatttatactggtgtatttcacatactacgcagactcgtgaggccattcacatctccaggacaattccaggactcggtttatcttcaaatgaacacgtgagagcgacgacacggcgtctattacngtncgagacaagtcgcgctcgggagtgttattagttgttgtacttcgtcgggtccgtacgggtaacccgtgttcgaccgtcgcccgttccggaccctccgaccgaacggggcccacgtccggtccgttccccgtcggtcctaccctcccgtccaacgcgcctaccgttcgtcgggggccacgcgccggcccgtgggtccgtcgccgttcggtaacgaacggtaacc

SEQ ID NO: 364680 - DNA, 710 bp, Homo sapiens
  misc_feature: GZ8MTXP01AJL8Y.44.38.D05.1.454.CMB.2.raw
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagctccgaggggaagggctggtgtgggtctcacgttattaatagtgagtgggagtagcacaagctacggcggactccgtaggaacggccgattcaccatccaccagacaccaacgccaaagaacacgctagtatcgtagacaaatacgaactagtcgtaggacggacgacccggaaggaccgaaacgggtcttggttacgttaatttaccgtggtacggacgaaagggtacgggtcccggggttagggacgggggttacggggttacgggggtagttacggacgtaaacgttaaccgttaaccgttaaccggttaacggttacggtacgggtaccggtcgggggtacggggaccggtaaccgggacccgtaccggtccgacccggtcctaccgtcgtacgtccctaccgaacccgaaccgggtccccacggtcccgttccccgttcccccggtcggccccgttcccgttccgcctccgaacggacgccgaccgttcggcggggaaccg

SEQ ID NO: 364681 - DNA, 553 bp, Homo sapiens
  misc_feature: GZ8MTXP01BKFSN.44.38.D05.1.454.CMB.2.raw
  modified_base (249)..(249): a, c, t, g, unknown or other
  modified_base (344)..(344): a, c, t, g, unknown or other
  modified_base (349)..(349): a, c, t, g, unknown or other
  modified_base (364)..(364): a, c, t, g, unknown or other
  modified_base (393)..(393): a, c, t, g, unknown or other
  modified_base (411)..(411): a, c, t, g, unknown or other
  modified_base (421)..(421): a, c, t, g, unknown or other
  modified_base (423)..(423): a, c, t, g, unknown or other
  modified_base (509)..(509): a, c, t, g, unknown or other
  modified_base (517)..(517): a, c, t, g, unknown or other
  modified_base (524)..(524): a, c, t, g, unknown or other
  modified_base (527)..(527): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactgggtccncaagctccgaggggaagggctggtgtgggtctcacgtattaatagtgagtgggatagcacaagctacgcggactcgtgaaggccattcaccatcncaganaccaacgcaaagacncgctagtaatctagacaaatgaacagtcngagacgcgagacacggtntgtatatacngngacaaggcggggcgggtggcgggtaggtcgggattgactatactacgtacgtaggtgtaacggcgttcggcgggacgaacgggacnccggttcncccgtcnccncgcgtcccttaccgaaccgaaccgcc

SEQ ID NO: 364682 - DNA, 615 bp, Homo sapiens
  misc_feature: GZ8MTXP01BHSFK.44.38.D05.1.454.CMB.2.raw
  modified_base (294)..(294): a, c, t, g, unknown or other
  modified_base (297)..(297): a, c, t, g, unknown or other
  modified_base (338)..(338): a, c, t, g, unknown or other
  modified_base (373)..(373): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtcgggtccgccaagctccgaggggagggctgggtgtgggtctcacgtattaatagtgagtgggatagcacaagctacgcggactcgtagaacggcatcacntcncagagacacgccaagaacacgctgtatctgacaaatgaacngtctagagacgccgagacaacggctgtgtattacngtgacaaggacgccgggtgggcgggtaggttcggggtagttgactatactaacgtacgtacgtagtacggtacggtcggggtcggggaccgtaacgggaccgacggtccgacccggtctcccgtcgtaccgtaccttcccgaacccgaacgggtccccttacgttcccggttcccgttcccccgtcggcccgttcccgttcgccgtcccgaacggtacgccgacccgtcggttcgggggccg

SEQ ID NO: 364683 - DNA, 696 bp, Homo sapiens
  misc_feature: GZ8MTXP01BTEVD.44.38.D05.1.454.CMB.2.raw
  modified_base (320)..(320): a, c, t, g, unknown or other
  modified_base (343)..(343): a, c, t, g, unknown or other
  modified_base (661)..(661): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgcaagctccgagggagggctggtgtggtctcagtattaatgtgagtgggatagcacaagctacggcggactccggtaggaacgggccattcaccatccaccagacgaccaacgcaaagaacncgctgtactctgacaaatgaacngtcagagacgaccggaggaccaacggtcttggtagttattacgtggtacgacgtaaagggcggtccggggtagggcggggtagggttcgggggtattcgactataccttaacgtacgtaacgggttgtacgggtacggtcggggtagggggacccgtaaacggggaccccgtacggtcccgtacccggttcctcccgtacgtaccgtcccgttaccccgaaacccgggtaacgggtaccccttcggtttcccccggttccccgtttccccccggcgggttccccgccccgttcggccccgttaccggaacgggtaccnccccggttacccggtccggggttcgggggaacccc

SEQ ID NO: 364684 - DNA, 528 bp, Homo sapiens
  misc_feature: GZ8MTXP01BA6YW.44.38.D05.1.454.CMB.2.raw
  modified_base (306)..(306): a, c, t, g, unknown or other
  modified_base (400)..(400): a, c, t, g, unknown or other
  modified_base (425)..(425): a, c, t, g, unknown or other
  modified_base (428)..(428): a, c, t, g, unknown or other
  modified_base (441)..(441): a, c, t, g, unknown or other
  modified_base (449)..(449): a, c, t, g, unknown or other
  modified_base (457)..(457): a, c, t, g, unknown or other
tcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccattcaccatctccagagacaacgccaaagaacacgctgtatctgacaaatgaacagtctgagagccgaggacacggctgtgtattactgtgacaagngccggtgcgggagttcgggggattgcatactactacgtacggtatgggacgtgtagggggacccaaaggggacccacgggtcaccgttctcctnagctccacaggcccatcgtctcccngcncctgctcaggacncacctcgnggggcacncgtcgccgtgggctgcttggtcaaggtactacttccttattactaactgtctgacggcgggcgttggaacg

SEQ ID NO: 364685 - DNA, 563 bp, Homo sapiens
  misc_feature: GZ8MTXP01D04W9.44.38.D05.1.454.CMB.2.raw
  modified_base (191)..(191): a, c, t, g, unknown or other
  modified_base (225)..(225): a, c, t, g, unknown or other
  modified_base (236)..(236): a, c, t, g, unknown or other
tcagacagtatatacacgaccggtgctcgatttagtatctgatagttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaacttgtctctgtatcaacatcatccaaggtaaacgcccccaaactcatcatctatgagcctaataagacggcctacgtagggtttacaatcgcttccactgcctccaagtcccgacaacaccggtcctccctagacaatctcgtacggctcgagcgtgagggacgaggctggtaatttattagttgttagcgttacaaggtattgttcgtcgctaatctaacttattcgtcttaggaacggtggaccgtaaaggttccaccgtcttaggccacgtcccgaaacggtcccaacccgtacttcgtccttaacgtccg

SEQ ID NO: 364686 - DNA, 560 bp, Homo sapiens
  misc_feature: GZ8MTXP01DKSQ8.44.38.D05.1.454.CMB.2.raw
  modified_base (290)..(290): a, c, t, g, unknown or other
  modified_base (298)..(298): a, c, t, g, unknown or other
  modified_base (356)..(356): a, c, t, g, unknown or other
  modified_base (366)..(366): a, c, t, g, unknown or other
  modified_base (374)..(374): a, c, t, g, unknown or other
  modified_base (473)..(473): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaagggctggtgtgggtctcacgtattaatgtgatgggatagcacaaagctacgcggactccgtgaaggccgattcaccntctcaganacaacgccaagaacacgctgtatctgacaaatgaacagtctgagagccgagcaacggntgtgtatacngtgcaagngccggtggcgggagttcggggagttgacatactactacgtacggtatgggtacgtcggtacggggccgaaagggaccgacggtccaccgtctaccctcncgtctccaccgaacgggcccagtccggttccgttccccgtggcccgcccttgccctccgcggacgccgttaccgttcggcggggccg

SEQ ID NO: 364687 - DNA, 615 bp, Homo sapiens
  misc_feature: GZ8MTXP01ADEP4.44.38.D05.1.454.CMB.2.raw
  modified_base (199)..(199): a, c, t, g, unknown or other
  modified_base (277)..(277): a, c, t, g, unknown or other
  modified_base (293)..(293): a, c, t, g, unknown or other
  modified_base (296)..(296): a, c, t, g, unknown or other
  modified_base (302)..(302): a, c, t, g, unknown or other
  modified_base (339)..(339): a, c, t, g, unknown or other
  modified_base (343)..(343): a, c, t, g, unknown or other
  modified_base (360)..(360): a, c, t, g, unknown or other
  modified_base (371)..(371): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccnccaagctccgaggggaagggctggtgtgggtctcacgtattaatgtgagtgggatagcacagctacggcggactcggngaacgggccattcacntcnccaganacaacgccaaagacagctagtatctgacaaatgaacngtcngagacgcgagacacggntgtgtattcgngtgacaaagcggcgggtggacgggtagggtcggggtagttgactactacttacgtacgtacggttagtcggtacggtcggggtacggggaccgaacggggacccgtacggtccgacccgtcgtcctcgtcgtccgtacccaccggaacggtccccttacggtcccggttcccgttcccccgtcgggcccgttcccgttacgcccgtaccgaacggacgcccgttaccggtccggcgggggcccg

SEQ ID NO: 364688 - DNA, 636 bp, Homo sapiens
  misc_feature: GZ8MTXP01BB2HY.44.38.D05.1.454.CMB.2.raw
  modified_base (249)..(249): a, c, t, g, unknown or other
  modified_base (274)..(274): a, c, t, g, unknown or other
  modified_base (336)..(336): a, c, t, g, unknown or other
  modified_base (359)..(359): a, c, t, g, unknown or other
  modified_base (436)..(436): a, c, t, g, unknown or other
tcagacagtatatacacgaccggtgctcgatttagtatctgatagttgggtttggggggaagaggaagactgacggtcctcccaggagttcaggtgctgggcaccttgggcacgggggaggtgtgtcacaagatttgggctctgggcaccgtgggcatgggggagcttagttcagcctggggggtccctgagactctcctgtgcagcctctggattcaccttcagtagctactggatgcacgtggtccncaagctccgaggggagggctggtgnggtctcacgtataatagtgagtgggatagcacagctacgcggactcgagaggcatcacatcncagacgaccaacgcaaagaaccncgtactgtaatccagaaccaaagtcgaaacagttcaggaacgacggacggacggacaggtctagtacttattactgngtaacgaaagggcggaccggggtggaccgggggtaggtttacgggggatttacggacttaaacgtaccgttaaacgttaccggtacgggttaagcgggtaaacgtttcgggacggggacccgtaaacgggggcccaccggtttccacccggttcctccgtaacgtaccgtcccttaccccgaacggttaaccccgggccc

SEQ ID NO: 364689 - DNA, 706 bp, Homo sapiens
  misc_feature: GZ8MTXP01EU7BB.44.38.D05.1.454.CMB.2.raw
  modified_base (298)..(298): a, c, t, g, unknown or other
  modified_base (346)..(346): a, c, t, g, unknown or other
  modified_base (399)..(399): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcaggtcggccccaaggaaagacggccaggacttaccgtggtagggggaaacaacgtagttaggaaagtaaaagtgtagacacgtggtaccagcagaagccaggccacggcccctgngcgtggtcatctattatgatcgcgaccggccctcgacgggactcccgngacgcgtattcctccgtcggtcctacccgaacgtccggtaacggggaaacccncccgggacccctaaccccgtacggaacccctacgtacccgacggaccgggtaacgggggtaaccggaaacggggcccgggggaatcgggaacggggtaccccgtaacgtttaacgttaccgtggtacgtagggttgggtaggggtaagttagggttaaggttacggtagacgtcgtacggttcggggttacggttcggggacgggtaacgggtacccgaaggtcgtacggttacccggtcgttacggtccgacggacccgaggcccgtaaccgccccttcggcctcgttccgtccgttccccgtccc

SEQ ID NO: 364690 - DNA, 577 bp, Homo sapiens
  misc_feature: GZ8MTXP01B2PSO.44.38.D05.1.454.CMB.2.raw
  modified_base (286)..(286): a, c, t, g, unknown or other
  modified_base (289)..(289): a, c, t, g, unknown or other
  modified_base (355)..(355): a, c, t, g, unknown or other
  modified_base (361)..(361): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactcgtgaaggcatcacntcncagagacacgccaagacacgctgtatctgacaaatgaacagtctagagagcgagacaacggctgtntattcngtgacgaagcggccgggtggcggggtaggttcggggagttcgactatactacgtacgtacggtagtcgggacgtcgggtcggggacgaacgggccgacggtccgaccgttctcccgtcacgtcctaccgaccgaacgggcccacgtcccgttccgttccccgtggcccgcccgttcgcctccgaacggtacgccgacccgttcggcggggaacccg

SEQ ID NO: 364691 - DNA, 654 bp, Homo sapiens
  misc_feature: GZ8MTXP01AWZ9S.44.38.D05.1.454.CMB.2.raw
  modified_base (199)..(199): a, c, t, g, unknown or other
  modified_base (293)..(293): a, c, t, g, unknown or other
  modified_base (314)..(314): a, c, t, g, unknown or other
  modified_base (340)..(340): a, c, t, g, unknown or other
  modified_base (392)..(392): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccncaagctccgagggagggctggtgtgggtctcagtattaatagtgagtgggatagcacaagctacgcggactccgtgaacggccattccacatcnccagagacaacgccaaagacncgtctgtactctgacaaagtgaaacncgtctaggacgacggcccggtaaggaaccaacgggcttggtagtaattacgnggttagacgaaaggcggccgggtggcggggtagggttcggggtagttcggactaacgttaaccgttagtaaccgttacgggtacgtacgggtaaccgttcggggtacggggaaccggaacgggacccggaccggtaccgtaccgtccgttcctccgtacgtcccttaccgaaccgaacgggtcccgacgtcccgttcccgttccccggtcgccgttcccgttcgtccgccgaacggacgaccgccgttcgcgggggaacccg

SEQ ID NO: 364692 - DNA, 664 bp, Homo sapiens
  misc_feature: GZ8MTXP01AYOIN.44.38.D05.1.454.CMB.2.raw
  modified_base (197)..(197): a, c, t, g, unknown or other
  modified_base (289)..(289): a, c, t, g, unknown or other
  modified_base (294)..(294): a, c, t, g, unknown or other
  modified_base (307)..(307): a, c, t, g, unknown or other
  modified_base (310)..(310): a, c, t, g, unknown or other
  modified_base (331)..(331): a, c, t, g, unknown or other
  modified_base (336)..(336): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcacgtggtccncaagctccgagggaagggctggtgtgggtctcacgttattaatagtgagtcgggatgcacaagctacgcgactcgtgaacggcatcacatcncaganacaacacaagacncgntgtatctagactaatagaacngtacngagacgcgagtacaacgggtctgtagtacttacgtgtacgacaaaggtcggacccgggtgggaccggggttaagggttccgggggtaagtttcggaactaacgttaacctaacgttaaccggtacgtaggttacgggtacgtcggggacggggaaccgaacggacccgtaccggtctacccggttcctacccgtacgtacgtacccgttaccgaaccggtaaccgggtcccttaacggttcccggttccccgttaccccggtcggccccgttcccgttcgtcccgtaccgcggaccgaccgttacccgttccgggaacgggaacccgg

SEQ ID NO: 364693 - DNA, 604 bp, Homo sapiens
  misc_feature: GZ8MTXP01BWDR1.44.38.D05.1.454.CMB.2.raw
  modified_base (202)..(202): a, c, t, g, unknown or other
  modified_base (283)..(283): a, c, t, g, unknown or other
  modified_base (296)..(296): a, c, t, g, unknown or other
  modified_base (326)..(326): a, c, t, g, unknown or other
  modified_base (343)..(343): a, c, t, g, unknown or other
  modified_base (349)..(349): a, c, t, g, unknown or other
tcagacagtatatacacgaccggtgctcgatttagtatctgatagctgggttttccttgttgctattttaaaaggtgtccagtgtgaggtgcagctggtggagtccggggggaggcttagttcaggccgtggggggtccctgagactctcctgtgcagcctctggattcaccttcagtagctactggatgcacgtgggtccnccaagctaccgaggggaggggctggtgtgggtctcgacgtattaatagtgagtggggatagcacaagctacggcgactcgngacggcattcacntcaccagacgacaacgaccaagaacaccgnttagactctagacaaancgaaangtcagagacgcgagacacgggctgtagtatacgtggtgacgtaaaggccggtcgggtggacgggtagggttcgggtagttcgactacgtaacgttacgtacgttacgtacgtgggtaccgtggggtacggggaccgaacgggacccgtacggtccgacccgttccgtacctcgtactccgtaccgacgaaccgggcccttcgtcccgttcccgtccctcggccgccttcgcctcgaacgcgccacgtcggcgggc

SEQ ID NO: 364694 - DNA, 605 bp, Homo sapiens
  misc_feature: GZ8MTXP01BHVIQ.44.38.D05.1.454.CMB.2.raw
  modified_base (257)..(257): a, c, t, g, unknown or other
  modified_base (286)..(286): a, c, t, g, unknown or other
  modified_base (297)..(297): a, c, t, g, unknown or other
  modified_base (319)..(319): a, c, t, g, unknown or other
  modified_base (338)..(338): a, c, t, g, unknown or other
  modified_base (346)..(346): a, c, t, g, unknown or other
  modified_base (361)..(361): a, c, t, g, unknown or other
  modified_base (371)..(371): a, c, t, g, unknown or other
  modified_base (386)..(386): a, c, t, g, unknown or other
  modified_base (391)..(391): a, c, t, g, unknown or other
  modified_base (405)..(405): a, c, t, g, unknown or other
  modified_base (419)..(419): a, c, t, g, unknown or other
  modified_base (422)..(422): a, c, t, g, unknown or other
tcagacagtatatacacgaccggtgctcgatttagtatctgatagttggggtttggggggaagaggaagactgacggtcctcccaggagttcaggtgctgggcaccttgggcacggggggaggtgtgtcacaagatttgggctctgggcaccgtgggcagtgggggagcttagttcagcctggggggtccctgagactctcctgtgcacgcctctggattccaccttcagtagctacgtggatgcacgtcgggtccncaagctcgagggagggtctggtgtggtcncacgtattaangtgatgggatgcacagctacgngactcgagaggccatcacntcacaganaccacgacaacgacncgctgtaacntacgacaaatgaacngtacngacgacgcgagacnggtctgtagtactntgngtacgaaaggcgggggtacccggttggggaccgggggtacggttagggggtatcggacttaacttaccgtaacttacggtacggttagaacgggtcgttgggaccgggttaacgacgggacgttccgggttccacccggtccttccaacgctaccgttacccgaacggttaacccgggtcccc

SEQ ID NO: 364695 - DNA, 914 bp, Homo sapiens
  misc_feature: GZ8MTXP01A0WFX.44.38.D05.1.454.CMB.2.raw
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcacgcccacctcaggtgtccaggtccggaccccgaagggaaacgtaccgggaccaagggtacttaaccgtgggtaacgggggaaaacaactaagttaggaaaagtaaagtgtacgacgtacgtacggtaaccagacgaaggaacgccgacggccaccggcccctggcgcgtcggtacagttcttaatttacgtaggtactacggcccggtaaccccggtcccctagggaaccgggtaccttccccggtaggacggtcggttaacttcccgtttacggtaccggtaccttaacccgtaaacccgttaccgggtaaacccgggggaaaacccgtcccgggggaccccctaaaccccgggtaccgtaaaccccgtaacggttacccgaaacggggcccgggtaaaccgggggttaaccggaaaaccggggttcccggggggaagttacggggaacccgggttacccggttaaacctttaggttaaaccccgggtgggtttaaccggaggggttaacgggttacggggttaaaggtttaaggggttaaccggggtttagtacgttaaacgttccggaggggtttacggggttacggggttcgggggaaccgggggacggttaaacccgaacggttcgtaccggggttaaccggtttcccggaagggttaccaaccgggacccgttaacgggccccgtccggtcccccggtgttacccgaccgtttcccgttccccgttaaccccgttccccc

SEQ ID NO: 364696 - DNA, 591 bp, Homo sapiens
  misc_feature: GZ8MTXP01EFZES.44.38.D05.1.454.CMB.2.raw
  modified_base (202)..(202): a, c, t, g, unknown or other
  modified_base (296)..(296): a, c, t, g, unknown or other
  modified_base (299)..(299): a, c, t, g, unknown or other
  modified_base (304)..(304): a, c, t, g, unknown or other
  modified_base (329)..(329): a, c, t, g, unknown or other
  modified_base (341)..(341): a, c, t, g, unknown or other
  modified_base (514)..(514): a, c, t, g, unknown or other
  modified_base (559)..(559): a, c, t, g, unknown or other
  modified_base (565)..(565): a, c, t, g, unknown or other
tcagacagtatatacacgaccggtgctcgatttagtatctgatagctgggttttccttgttgctattttaaaaggtgtccagtgtgaggtgcagctggtggaggtccggggggaggcttagttcagccgtggggggtccctgagctctcctgtgcagcctctggattcaccttcagtagctactggatgcacgtgggtcccnccaagctccgagggaggggctgggtgtgggtctcacgtattaatagtgatgggatagcaacaagctacggcggactcgagaacggcattcaccntcncaganacaacgcaaagacagctgtatctanacaaatgaaacngtctagaggacgccgaggacaacgggtctggtataattacgtggtacacgaaagggcggccgggtaggacggggtaggtcggggtagttagactaatactaacgtactacggtagtaggaccgttcggggacggggaccgaacgggaccgaccgtccgacccgtctcctcgancctccaaccgaacggccacgtccgttccttccccgtgcccgcccncgtccncgaaggcgcaccgtcggcgggaaccg

SEQ ID NO: 364697 - DNA, 552 bp, Homo sapiens
  misc_feature: GZ8MTXP02G4GTP.44.38.D05.1.454.CMB.2.raw
  modified_base (267)..(267): a, c, t, g, unknown or other
  modified_base (304)..(304): a, c, t, g, unknown or other
  modified_base (432)..(432): a, c, t, g, unknown or other
tcagacagtatatacacgaccggtgctcgatttagtatctgatagttcagcctgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccgattcaccatctcagagacaacgccaagaacacgctgtatctgacaaatgaaacagtcngagagccgaggacacggctgtgtattactgtgcaagngccgggtgcgggagttcggggattgcatactactactacggtatggacgtcgtgggggaccaaaggggccacgggtcaccgtctcctcagctccaccgaacgggcccacgtccggtcccttcccccgnggcccgcccctgcctcccgaggacgccgacctccgagacgcacacgccggccctgggcctgcccgtggtaccaaacggtacctaccttcctaataactactcgtctggacgcgggctcgg

SEQ ID NO: 364698 - DNA, 544 bp, Homo sapiens
  misc_feature: GZ8MTXP02G3LS1.44.38.D05.1.454.CMB.2.raw
  modified_base (306)..(306): a, c, t, g, unknown or other
  modified_base (358)..(358): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaaggccattcaccatctccagagacaacgccaaagaacacgctgtatctgcaaaatgaaacagtctgagagccgaggacacggctgtgtattactgtgacaaagngccgggtgcggggagttcggggattgcatactactactacgtatggactcgnggggccaaagggaccacggtcaccgtctcctcagcttccacaacgggcccatccggtccttcccccgtgccgcccctgcctccacggacgcacctcgcgggcgacgacgcggcccgtcggcgtcgccgtcggtcgaacggactacttacctactactaactcgtcgtgacgcggcgcgacgacgcg

SEQ ID NO: 364699 - DNA, 536 bp, Homo sapiens
  misc_feature: GZ8MTXP02G4233.44.38.D05.1.454.CMB.2.raw
  modified_base (301)..(301): a, c, t, g, unknown or other
tcagacagtatatacacgaccggtgctcgatttagtatctgatagttcagcctggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaaggccgattcaccatctccagagacaacgccaagaacacgctgtatctgcaaatgaacagtctgagagccgaggacacggctgtgtattactgtgcaagngccggtgcgggagttcggggattgcatactactactacggtatggacgtcgtggggccaaaggggaccacgggtcaccgtctcctcacgcttccaccaacgggcccacgtccggtccttcccccgtcggccgccctgcctccaggacgcaccgtcgtcgggggcacgacgccggcccgtgggcctcgccctggtccaaaggactacttcctatataactgtctgagcggctggcg

SEQ ID NO: 364700 - DNA, 598 bp, Homo sapiens
  misc_feature: GZ8MTXP02I4CXQ.44.38.D05.1.454.CMB.2.raw
  modified_base (362)..(362): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctggtgggggaaacaacattggaaagtaaagtgtgcactggtaccagcagaagccaggccaggcccctgtgctggtcatctattatgatagcgaccggccctcgagggactccctgagcgattctcctggcctccaactctagggaacncggccaccctgacccatcagcgaggggtcgaaaggcccggggatcggacggaccgactaattaccgtgtcgaagggttggtggggaattaggtaggttagtgattacgaggttccgggggttggttccggggacggggaacggggaacccgaaggtccgtacggacccgtccgtaggtaccgacggaccccgaaggcctccgcccccgtcggtccacctcctccgtccccgtcccc

SEQ ID NO: 364701 - DNA, 538 bp, Homo sapiens
  misc_feature: GZ8MTXP02H3MKM.44.38.D05.1.454.CMB.2.raw
  modified_base (273)..(273): a, c, t, g, unknown or other
  modified_base (358)..(358): a, c, t, g, unknown or other
  modified_base (365)..(365): a, c, t, g, unknown or other
  modified_base (459)..(459): a, c, t, g, unknown or other
  modified_base (519)..(519): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctgggggtccctgagactctcctgtgcagcctctggattcaccttcagtagctactggatgcactgggtccgccaagctccagggaagggctggtgtgggtctcacgttattaatagtgatgggatagcacaagctacgcggactccgngaaggccattcacatctccagagacaacgccaagacacgctgtatctgacaaatgaacagtctgagagccgaggacacggctgtntattacngtgcaagcgccggtgcgggaggttcggggagttgactagtactactactacgtatggacgtcgtgggcgaacgggaccacggtcaccgtctccncacgctaccacgacggccactccgtccttccccgtcgccgccctcgccgtccgacggacnccgaccgtcgtacggggcc

SEQ ID NO: 364702 - DNA, 553 bp, Homo sapiens
  misc_feature: GZ8MTXP02HRT9V.44.38.D05.1.454.CMB.2.raw
  modified_base (277)..(277): a, c, t, g, unknown or other
  modified_base (294)..(294): a, c, t, g, unknown or other
  modified_base (319)..(319): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcactgggtccgccaagctccgaggggaagggctggtgtgggtctcagtattaatagtgatgggatagcacaagctacgcggactccgngaaggccatcaccatcnccagagacaacgccaaagaacacgntgtatctgacaaaatgaaacagtctgagagccgaggtacacggctgtagtattactgtgacaaagcgccgggtgcggggagttcgggggattgcagtactactagtacggtatgggacgtcgtcgggggaccaaaaggggccaacggtccaccgtctcctcagtctcaccaacggaccgacgtccgtccgttcccgtccgccgccctcgcgtccacgacgcgacctcgtcggcg

SEQ ID NO: 364703 - DNA, 547 bp, Homo sapiens
  misc_feature: GZ8MTXP02GDCZN.44.38.D05.1.454.CMB.2.raw
tcagacagtatatacacgaccggtgctcgatttagtatctgatagttgggtttggggaagaggaagactgacggtcctcccaggagttcaggtgctgggcaccttgggcacggggaggtgtgtcacaagatttgggctctgggcaccgtgggcatggggaggcttagttcagcctgggggtccctgagactctcctgtgcagcctctggattcaccttcagtagctactggatgcactgggtccgccaagctccagggaaggggctggtgtggggtctcacgtattaatagtgatgggatagcacaagctacgcggactccgtgaaggccgattcaccatctccagagaccaacgccaagaacacgctagtatctgcaaatgaaacagtctgagagccgagacacgctgtgtattactgtgacaagagccggtgcgggagttcggggagttgcatactactacgtacggtatcggacgtcgtggggaccaaggggaccacgggtccaaccggtctcccgtcacggccttaccaccgaaacgggcccc

SEQ ID NO: 364704 - DNA, 540 bp, Homo sapiens
  misc_feature: GZ8MTXP02F5MAU.44.38.D05.1.454.CMB.2.raw
  modified_base (525)..(525): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctgggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaaggccgattcaccatctccagagacaacgccaaagaacacgctgtatctgcaaaatgaaacagtctgagagccgaggacacggctggtgtattactgtgcaaagagccggtgcgggagttcggggagttgcatactactactacggtatggacgtcgtggggaccaagggaccgacggtcaccgtctccgtcagctccaccgaacgggcccatccggtccttccccgtcgccgccctgcctccgaggacncgacctcgcggggcc

SEQ ID NO: 364705 - DNA, 554 bp, Homo sapiens
  misc_feature: GZ8MTXP02JDVJC.44.38.D05.1.454.CMB.2.raw
  modified_base (268)..(268): a, c, t, g, unknown or other
  modified_base (297)..(297): a, c, t, g, unknown or other
  modified_base (307)..(307): a, c, t, g, unknown or other
  modified_base (352)..(352): a, c, t, g, unknown or other
  modified_base (362)..(362): a, c, t, g, unknown or other
tcagacagtatatacacgaccggtgctcgatttagtatctgatagttcagcctgggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaaggccattcaccatctccagagacaacgccaaagaacacgctgtatctgacaaaatgaacagtcngagagccgaggacacggctgtgtattacngtgacaaggngcccgggtgcgggagttcggggattgcatactactacgtacggtntggacttcgnggggaccaaaggggcccaggtcaccgtctcctcagctccacaaggcccagtccggtccttcccccgtggccgccctgcctccgaggcgcacctcgcggggcacgacggccggcccgtggggctcggacccgttggtaccgaaaggaccttaccttacctattataacgtgtctacggacggcggcgtcggcg

SEQ ID NO: 364706 - DNA, 559 bp, Homo sapiens
  misc_feature: GZ8MTXP02GJZ9M.44.38.D05.1.454.CMB.2.raw
  modified_base (315)..(315): a, c, t, g, unknown or other
  modified_base (358)..(358): a, c, t, g, unknown or other
  modified_base (429)..(429): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctggtggggaaacaacattggaaagtaaagtgtgcactggtaccagcagaagccaggccaggcccctgtgctggtcatctattatgatagcgaccggccctnagggactccctgagcgattctctggcctcaactcgtaggaacncggccaccctgacccatcagcgagggtcgaagccgggggatggacgaccgacttatacgtgtacgaggtgngggatagtagtagtgactcagtcggggtgttcgggcgggagggaccaagcgtacggaccgtccgtaggtccacggacccaacgggcctaacgcccccgttcggtaccaccgtctccggttcccctccccg

SEQ ID NO: 364707 - DNA, 577 bp, Homo sapiens
  misc_feature: GZ8MTXP02JENIN.44.38.D05.1.454.CMB.2.raw
tcagacagtatatacacgaccggtgctcgatttagtatctgatagttcagcctgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgacaaatgaacagtctgagagccgaggacacggctgtgtattactgtgcaagagccgggtgcgggagttcggggattgcatactactactacggtatggacgtcgtgggggccaaagggggacccacgggtcaccgtctccctcacgccttccaccgaacgggcccacgtccggtcccttccccccgtcggcccgtcccctcgccctcccgacggacgccgacccgtcgtcgggggccaccgacggccggccccgtgggcctcgcccgtcggtcgaacggtacctacttcccgtatactaacgtgtcctggacgcggctggacg

SEQ ID NO: 364708 - DNA, 537 bp, Homo sapiens
  misc_feature: GZ8MTXP02HNALD.44.38.D05.1.454.CMB.2.raw
  modified_base (355)..(355): a, c, t, g, unknown or other
  modified_base (456)..(456): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaagtaaagtgtgcactggtaccagcagaagccaggccaggcccctgtgctggtcatctatatgatagcgaccggcctcagggactccctgagcgattctctggctccaactcgtgggaacncggccacctgaccatcagcgagggtcgaaggccggggatggaggccgactattactgtcaggtgtgggataggtagtagtgatcgagtcgggtgttcgggnggtagggacaaggtcgtacggaccgtcgtacggtcacgcccgaaggctcgccccgtcggtcactccgtcgttccccgtccc

SEQ ID NO: 364709 - DNA, 535 bp, Homo sapiens
  misc_feature: GZ8MTXP02F3YJF.44.38.D05.1.454.CMB.2.raw
  modified_base (368)..(368): a, c, t, g, unknown or other
  modified_base (376)..(376): a, c, t, g, unknown or other
tcagacagtatatacacgaccggtgctcgatttagtatctgatagctgggtttccttgttgctatttaaaggtgtccagtgtgaggtgcagctggtggagtccggggaggcttagttcagcctgggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaaagaacacgctgtatctgcaaaatgaaacagtctgagagccgaggacacggctgtgtattacngtgcaagngcgtgcgggagtcggggagttgcatactactactacggtatggacgtcgtggggccaagggaccacggtcgaccgtctcctcagcgtccaccgaacggcccactccgtcttccccgtcgccgccctcgccgtccgacggacgccacctccgtcgggggc

SEQ ID NO: 364710 - DNA, 595 bp, Homo sapiens
  misc_feature: GZ8MTXP02G5MBQ.44.38.D05.1.454.CMB.2.raw
  modified_base (257)..(257): a, c, t, g, unknown or other
  modified_base (335)..(335): a, c, t, g, unknown or other
  modified_base (339)..(339): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcanaagctacgcggactcgtgaaggccattcaacatctccagagacaacgccaagaacacgctgtatctgacaaatgaacngtcngagagccgaggacacggctgtgtattacgtgtgacaagacgccgggtggcgggtaggttcgggggagttgactactactacgtacgtacggtagtagggacgtcgtacggggaccgaacgggaccgacggtccgacccgtctcctcgacgtccttacccaccgaaacgggcccctacgttcccggtcccttcccccgcggtcccgccccgttcgcccgtcccgaacggccgaccgtacccgtcggcgggggacccg

SEQ ID NO: 364711 - DNA, 584 bp, Homo sapiens
  misc_feature: GZ8MTXP02JTQIP.44.38.D05.1.454.CMB.2.raw
  modified_base (371)..(371): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaagggccattcaccatctcagagacaacgccaagacacgctgtatctgacaaatgaacagtctgagagccgaggacacggctggtgtattacgngtgacaaaggcgccgggtggcggggtaggttcgggggagttgacatactacgtacgtacggtagtggacgtcgtcgggggaccgaaggggacccgacggtccacccggtcctccctcacgtccttacccaaccgtaacggggccccacgtccggtcccttccccgtcggcccgccctcgccgtccgacggcgccgaccgtcggtcggggaccc

SEQ ID NO: 364712 - DNA, 564 bp, Homo sapiens
  misc_feature: GZ8MTXP02JRM5W.44.38.D05.1.454.CMB.2.raw
  modified_base (360)..(360): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaagtaaaagtgtgcatggtaccagcagaagccaggccaggcccctgtgctggcatctatatgatagcgaccggccctcagggactcccgtgacgcgattctcctggctccaactcgtaggggaacnccgggcccaccctcgaccatcagcgaggggtcgaaacggcccgggggatcggacggccgacgtacttacgtgtacgaggtggtgggtataggtagtagtgatcgagtcggggtgtcgggcggtagggacgaagcgtgaccgtcgtacggtcgacgcccgaaggccgtccgccccgtcggtcctaccgtcctccgtcccgtcccc

SEQ ID NO: 364713 - DNA, 557 bp, Homo sapiens
  misc_feature: GZ8MTXP02FV3UP.44.38.D05.1.454.CMB.2.raw
  modified_base (368)..(368): a, c, t, g, unknown or other
  modified_base (377)..(377): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccgccaagctccgagggaaggggctggtgtgggtctcacgtattaatagtgatgggatagcacaagctacgcggactcgtgaaggccatcaccatctccagagacaacgccaagaacacgctgtatctgcaaaatgaaacagtctgagagccgaggacacggctgtgtattacngtgcaaagngccggtggcggggagttcggggagttgcatactactactacggtatggacgtcgtggggccaagggaccgacggtccaccgtctcctcacgccttccaccgaacgggcccacgtccggttccttcccccgtcggcccgcccgtcgcctcccgacggacgccgaccgtcggtcgggggccg

SEQ ID NO: 364714 - DNA, 430 bp, Homo sapiens
  misc_feature: GZ8MTXP02J3QJO.44.38.D05.1.454.CMB.2.raw
  modified_base (360)..(360): a, c, t, g, unknown or other
  modified_base (430)..(430): a, c, t, g, unknown or other
tcagacagtatatacacgaccggtgctcgatttagtatctgatagttgggtttgggtctcacgtattaatagtgatgggagtagcacaagctacgcggactccgtgaagggccgattcaccatctccagagacaacgccaagaacacgctgtatctgcaaaatgaacagtctgagagccgaggacacggctgtgtattactgtgcaagagccggtgcgggagttcggggattgcatactactactacggtatggacgtctggggccaaggggaccacggtcaccgtctcctcagcttccaccagggcccatcggtccttccccctggcgccctgctccaggagcacctctcgggggcacncgcggccctggctgcctggtcaaggactcttcctatatactgtctgagcggggctggcaaggcgcatagn

SEQ ID NO: 364715 - DNA, 514 bp, Homo sapiens
  misc_feature: GZ8MTXP02H9AYE.44.38.D05.1.454.CMB.2.raw
  modified_base (283)..(283): a, c, t, g, unknown or other
  modified_base (315)..(315): a, c, t, g, unknown or other
  modified_base (324)..(324): a, c, t, g, unknown or other
  modified_base (335)..(335): a, c, t, g, unknown or other
  modified_base (350)..(350): a, c, t, g, unknown or other
  modified_base (369)..(369): a, c, t, g, unknown or other
  modified_base (404)..(404): a, c, t, g, unknown or other
  modified_base (411)..(411): a, c, t, g, unknown or other
  modified_base (444)..(444): a, c, t, g, unknown or other
  modified_base (459)..(459): a, c, t, g, unknown or other
  modified_base (503)..(503): a, c, t, g, unknown or other
  modified_base (512)..(512): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattaggaaagtaaaagtgtgcactggtaccagcagagccaggccaggcccctgngctggtcatctattatgatagcgaccggcctnagggatccngagcgatctcngctcaatctggaacncgccaacctgaccatcgancagggtacgaaagccggggatggagccgatatacngtcaggngtgggatagtagagtgatcagtcgggtgtcggnggaggaccgaagcgngaccgtcaggtcagcccgaaggcctcggcccctacggcactccncgttccccncc

SEQ ID NO: 364716 - DNA, 558 bp, Homo sapiens
  misc_feature: GZ8MTXP02JBMLE.44.38.D05.1.454.CMB.2.raw
  modified_base (274)..(274): a, c, t, g, unknown or other
  modified_base (290)..(290): a, c, t, g, unknown or other
tcagacagtatatacacgaccggtgctcgatttagtatctgatagctgggttttccttgttgctattttaaaaggtgttcagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggatagcacaagctacgcggactccgngaaggccatcacatcnccagagacaacgccaagaacacgctgtatctgacaaatgaacagtcagagagccgaggacacggctggtgtattactgtgacaaaggcgccgggtggcggggtaggttcgggggagttgacatactactacgtacggtagtggtacgtcgtcggggcgaacgggaccgacggtccaccgtctcctcacgtctccaccgaacggcccacgtccggtccttccccgtcggcccgccctcgcctccgacggacgcgaccgtcgtcggggcg

SEQ ID NO: 364717 - DNA, 550 bp, Homo sapiens
  misc_feature: GZ8MTXP02GN1ZL.44.38.D05.1.454.CMB.2.raw
  modified_base (197)..(197): a, c, t, g, unknown or other
  modified_base (335)..(335): a, c, t, g, unknown or other
  modified_base (339)..(339): a, c, t, g, unknown or other
  modified_base (362)..(362): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccnccaagctccgagggaagggctggtgtgggtctcacgtattaatgtgatgggatagcacaagctacgcggactccgtgaaggccattcaccatctccagagacaacgccaagaacacgctgtatctgacaaatgaaacngtcngagagccgaaggacacggctgtntattacgtgtgcaaagcgccggtggcgggagttcggggagttgcagtactactacgtacgtagtggacgtcgtcggggaccgaagggaccgacgtccgaccgtctcctcagctccaccgacggcccacgtccgtcctccccgtcgccgcccgtcgccgtccgacggacgccaccgtcgtcggggaccg

SEQ ID NO: 364718 - DNA, 584 bp, Homo sapiens
  misc_feature: GZ8MTXP02H20IS.44.38.D05.1.454.CMB.2.raw
  modified_base (300)..(300): a, c, t, g, unknown or other
  modified_base (349)..(349): a, c, t, g, unknown or other
  modified_base (547)..(547): a, c, t, g, unknown or other
  modified_base (570)..(570): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcactgggtccgccaagctccgaggggagggctggtgtgggtctcacgttattaatagtgatgggagtagcaacaagctacgcggactccgtgaagggccgattcaccatcnccagagacaacgccaaagaaccacgctgtatctgacaaatgaacagtcnggagacgccgaggacacggcttggtgttaattacctgtagacaaagcggccgggtggcggggtagttcgggggagttgactaatactactaacgtacggtagtggacgtcggtggggaccgaacgggaccacgggtccaccgttctcccgtacacgctaccaaccgaacggcccagtccggtccttccccctggcccncccgtcgaacctccgaacggccnccaccgtcggcggc

SEQ ID NO: 364719 - DNA, 595 bp, Homo sapiens
  misc_feature: GZ8MTXP02IBNHO.44.38.D05.1.454.CMB.2.raw
  modified_base (251)..(251): a, c, t, g, unknown or other
  modified_base (307)..(307): a, c, t, g, unknown or other
  modified_base (341)..(341): a, c, t, g, unknown or other
  modified_base (438)..(438): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcagtgggggaggcttagttcagccgtgggggtccctgagactctcctgtgcagcctctggattcacctttcagtagctactggatgcactgggtccncaagctccgagggagggctggtgtgggtctcacgtataatagtgatgggatagcanaagctacgcgactccgtgaaggccattcacatcncagagaccaacgacaagaacacgctgtatctagactaaaatgaacagttcagagagaccgaggacgacgctagtagtaacttactgtagacgaaagnggtccgggttggacggggtacggttacgggggagttgactaagtactaacgtacgtaacggtatcgggacgttcggacgggaccgaaacggggacccacgggttccaacccgttcgttcccgacgacgtaccttacccgaaccgtaacgggtacccc

SEQ ID NO: 364720 - DNA, 537 bp, Homo sapiens
  misc_feature: GZ8MTXP02HHMPH.44.38.D05.1.454.CMB.2.raw
  modified_base (324)..(324): a, c, t, g, unknown or other
  modified_base (359)..(359): a, c, t, g, unknown or other
  modified_base (424)..(424): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattggaagtaaaagtgtgcactggtaccagcagagccaggccaggcccctgtgctggtcatctattatgatagcgaccggcctcagggactcccngagcgattctcctggcctccaactcgtcgggaacnccggcccaccctcgacccatcagccgagggtcgaaacggccgggatggacggccgactattacgngtcgaggtgtgggatagtagtagtgatcgagtcgggtgttcggcggaggaccgaagcgtgaccgtcagggtcacgcccaaggctcgcccctcggtcactctcgttccccgccc

SEQ ID NO: 364721 - DNA, 599 bp, Homo sapiens
  misc_feature: GZ8MTXP02HBMWC.44.38.D05.1.454.CMB.2.raw
tcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccgattcaccatctccagagacaacgccaagaacacgctgtatctgcaaatgaacagtctgagagccgaggacacggctgtgtattactgtgcaagagccggtgcgggagttcggggattgcatactactacgtacggtatggactcgtggggccaaagggccacggtcaccgtctcctcacgcttccaccaacgggcccacgtccggtcccttcccccgtcggcccgtccccgtcggcccttcccgacgggacgccgaacccgtcgtgggggcccccagacggccgggccccgttcggggccgttcggcccgttcgggtaccgaaacgggtaccttaccgtttacccctaattaacttaacgtcgttccgtgacggtccgggctcgggacg

SEQ ID NO: 364722 - DNA, 556 bp, Homo sapiens
  misc_feature: GZ8MTXP02F3OPT.44.38.D05.1.454.CMB.2.raw
  modified_base (290)..(290): a, c, t, g, unknown or other
  modified_base (337)..(337): a, c, t, g, unknown or other
  modified_base (367)..(367): a, c, t, g, unknown or other
tcagacagtatatacacgaccggtgctcgatttagtatctgatagctgggttttccttgttgctattttaaaggtgtccagtgtgaggtgcagctggtggagtccggggaggcttagttcagcctggggggtccctgagactctcctgtgcagcctctggattcaccttcagtagctactggatgcactgggtccgccaagctccagggaagggctggtgtgggtctcacgtattaatagtgatgggatagcacaagctacgcggactccgtgaaggccattcaccatcnccagagacaacgccaagaacacgctgtatctgcaaaatgaacagtcngagagccgaggacacggctgtgtattacgngtgacaaagagccggtggcgggaggttcggggagttgcagtactactacgtacgtagtaggacgtcgtcggggacgaacgggaccgacggtccaccgtctcctcacgcctccaccgaacggcccacgtccggtccttccccgtcggccgccctcgccgtccgacggacgccgaccgtcgtcggggaccg

SEQ ID NO: 364723 - DNA, 553 bp, Homo sapiens
  misc_feature: GZ8MTXP02JE4IL.44.38.D05.1.454.CMB.2.raw
  modified_base (307)..(307): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccattcaccatctccagagacaacgccaaagaacacgctgtatctgacaaaatgaaacagtctgagagccgaggacacggctgtgtattactgtgacaagngccggtggcggggagttcggggattgcatactactactacggtatggacgtcgtggggccaaaggggacccacgggtccaccggtctccctcacgccttccaccaaacgggcccatccggtccttccccctggccgccctgcctccgaggacgcaccgtcgtcgggggcacgacgcggccctgggctgcctggtacaaggtacctacttacctatactactgtcgtgcggcgggctggcaacggcg

SEQ ID NO: 364724 - DNA, 609 bp, Homo sapiens
  misc_feature: GZ8MTXP02FULI3.44.38.D05.1.454.CMB.2.raw
  modified_base (247)..(247): a, c, t, g, unknown or other
  modified_base (305)..(305): a, c, t, g, unknown or other
  modified_base (322)..(322): a, c, t, g, unknown or other
  modified_base (347)..(347): a, c, t, g, unknown or other
  modified_base (387)..(387): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagcctgggggtccctgagactctcctgtgcagcctctggattcaccttcagtagctactggatgcactggtccncaagctccagggagggctggtgtgggtctcacgtattaatagtgagtgggagtagcanaagctacgcgactccgngaagggccatccaccatcctcaganaccaacgccaaagacacgctgtatctgacaaaatgaaacngtctagagacgcgaaggacacggctgttagtattactgtcgacgaaggacgcccggggttggaccgggggtaaggtttccgggggaatttcggactaacgttaacctacgtacgtacggtagtcgggaccgtggtcgggggacccaaaggggacccctaacgggtcctaacccggtcttaccccgacgacggtcccttacccgaaccggtaacgggtccccc

SEQ ID NO: 364725 - DNA, 569 bp, Homo sapiens
  misc_feature: GZ8MTXP02F7R2D.44.38.D05.1.454.CMB.2.raw
tcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccattcaccatctccagagacaacgccaagaacacgctgtatctgcaaatgaacagtctgagagccgaggacacggctgtgtattacgtgtgacaaggagcccggtggcggggagttcggggattgcactactactacgtacggtatgggacgtcgtgggggccaaaggggcccacggtcaccgtctcctcacgcttccaccgaacgggcccactccggtccttcccccgtcggccgccctcgcctccgaggacgccgaccgtccgtcgggggcaccgacggccggcccgtcgggctcgccgtcggtacaaacggtacctacttacctattactaactcgtctcggacggcggcgtggacg

SEQ ID NO: 364726 - DNA, 530 bp, Homo sapiens
  misc_feature: GZ8MTXP02ILAGF.44.38.D05.1.454.CMB.2.raw
tcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaattcgaagaacacactatatctggaaatgaatagcctgagagccgaggacacggctgtctactactgtgcgagagatggggctcgtggatacagatatgacatgctctactccaatggtatgacgcgtggggccaagggcacggtcgccgtctcctcacgcctccaccgacgggcccatccggtccttccccctggccctaccctccctccaacgacgcaccgtcgtcgggggcacgacgccggcccgtcggggctcgcccgtcggtcaacggaactacttcctatactactcgtctgg

SEQ ID NO: 364727 - DNA, 637 bp, Homo sapiens
  misc_feature: GZ8MTXP02JGUG8.44.38.D05.1.454.CMB.2.raw
  modified_base (249)..(249): a, c, t, g, unknown or other
  modified_base (290)..(290): a, c, t, g, unknown or other
  modified_base (304)..(304): a, c, t, g, unknown or other
  modified_base (382)..(382): a, c, t, g, unknown or other
  modified_base (450)..(450): a, c, t, g, unknown or other
  modified_base (465)..(465): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagccgtgggggtccctgagactctcctgtgcagcctctggattcaccttcagtagctactggatgcacgtggtccncaagctccgaggggagggctggtgtggtctcacgtattaangtgatggatagcanaagctacgcggactccggtaggaacgggcctattccgaactactcctaccgaagacaacccaaccgccaaaagaaccncgctagtactcctagaaccaaaagtcgaaactagttcaggagacggacccggaaggaccacggggttnttgtagttattacgngtacgaacgaagggcgggtccgggtgggacggggttagggttacggagttcgacttaactacgtaacgtacggtaggtacgtacgggacggtacgggaccgggaaccgtaaccgggcccgtacggtcctaccgtccgtaccgtacgacgtacccgtaccgaccggacgtccc

SEQ ID NO: 364728 - DNA, 675 bp, Homo sapiens
  misc_feature: GZ8MTXP02GWEZP.44.38.D05.1.454.CMB.2.raw
  modified_base (260)..(260): a, c, t, g, unknown or other
  modified_base (296)..(296): a, c, t, g, unknown or other
  modified_base (302)..(302): a, c, t, g, unknown or other
  modified_base (338)..(338): a, c, t, g, unknown or other
  modified_base (374)..(374): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagctccgaggggaagggctgggtgtgggtctcacgtattaatagtgatgggatagcanaagctacgcggactccgtgaaggccgattcacatcnccaganacaacgccaagaacacgctgtatctgcaaatgaacngtctagagacgccgaggacacggctgtgtattacgngtacgacaaagggacgccggggtggacgggggtagggttacgggggagtttcggacgtaacgtaacgttaacgtaacgttacgggtagtacgggtaccggttcggtacgggggtacccggaaacggggacccgaccgggtaccgtaacccggtccttccctaccgacgtacccgttacccgaacccgtaaaccgggcccctacgttcccggttccccgttcccccggtcgggtccccgccccgtcggtcccgtacccggaacggtccgtacccgtacccgttccgggtcgggggtaacccg

SEQ ID NO: 364729 - DNA, 594 bp, Homo sapiens
  misc_feature: GZ8MTXP02IF0KU.44.38.D05.1.454.CMB.2.raw
  modified_base (247)..(247): a, c, t, g, unknown or other
  modified_base (568)..(568): a, c, t, g, unknown or other
  modified_base (577)..(577): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatggggaggcttagttcagccgtgggggtccctgagactctcctgtgcagcctctggattcaccttcagtagctactggatgcactggtccnccaagctccaggggaaggggctggtgtgggtctcacggtattaatagtgatgggagtagcacaagctaacgcggactccgtggaaggccattcacatctccagagaccaacgccaaagaaccacgctgtatctaggaccaaatgaaacagtcctagagaggtacccgaggaccacggtctaggttgtacttcagtgaccgtaaaggggccgcgggttaggcgggttagggtcggtaagtcgactaacttaccgtacgtaccgtaaggtgtaacggtcggtcgggacggaaacggaccgcgtaaccgtcaaccgtcctcganccgttaccnccgaaacggccgtaccc

SEQ ID NO: 364730 - DNA, 671 bp, Homo sapiens
  misc_feature: GZ8MTXP02IJFDN.44.38.D05.1.454.CMB.2.raw
  modified_base (203)..(203): a, c, t, g, unknown or other
tcagacagtatatacacgaccggtgctcgatttagtatctgatagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccggngaaggccgattcaccatctccagagacaacgccaagaacacgctgtatctgcaaatgaacagtctgagagccgaggacacggctgtgtattactgtgcaaggcggcccgggtggcggggtaggttcggggagttgcatactactacgtacggtatgggactcgtggggccaaacgggggacccacggggtcacccggttctcctcgacgtccttcccgaacccgaacggggcccctaacgttcccgggttcccctttcccccccgtcgggccccgtcccccgttccggtcccttacccggaacgggaccgtcccgaccccgttccggtcggggggaccaccggtacgggcccgggtccccggtcggggcccgttcggcccggttacggtaccgaaacgggtaaccttaccgtttacccttattaacgtaacgttcgtccgttggacggtccgggtacgtcgggaaccg

SEQ ID NO: 364731 - DNA, 613 bp, Homo sapiens
  misc_feature: GZ8MTXP02IWDE4.44.38.D05.1.454.CMB.2.raw
  modified_base (199)..(199): a, c, t, g, unknown or other
  modified_base (279)..(279): a, c, t, g, unknown or other
  modified_base (297)..(297): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccnccaagctccgagggaagggctggtgtgggtctcacgtattaatagtgagtgggagtagcacaagctacggcggactccgngaacggccatcaccatcnccagagacaacgcaaagaacacgctgtatctgacaaatgaaacagtcagagacgccgaggacacggctgtgtattacgtgtagacaaagacggccgggtggcggggtaggttcgggggtagttgactactaactacgtacgtacggtagtagggacgttcggtacggggaccgaacgggaccgtaaccggtccaccggtcctccctcgaccgtccgtacccgaaccgaacgggtccctacgttcccggttcccttcccccgtcggccccgtcccgtcgcccgtaccgaacggccgccgaccgttcggcggggaccg

SEQ ID NO: 364732 - DNA, 503 bp, Homo sapiens
  misc_feature: GZ8MTXP02I8X9A.44.38.D05.1.454.CMB.2.raw
  modified_base (189)..(189): a, c, t, g, unknown or other
  modified_base (311)..(311): a, c, t, g, unknown or other
  modified_base (320)..(320): a, c, t, g, unknown or other
  modified_base (359)..(359): a, c, t, g, unknown or other
  modified_base (496)..(496): a, c, t, g, unknown or other
tcagacagtatatacacgaccggtgctcgatttagtatctgatagttgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctcctggtatcaacatcatccaggtaaacgcccccaaactcatcatctatgagcctanaagagcctnagggttctaatcgcttccactgcctcaagtcccggcacncggccctccctgaccaatctctcgggctcccaggctgaggacgaggctagtattagttattgttgctcagattgtcgtcgctatccattatgtcttcggaagtggacaagtcacgtcagtcagcccaagccaaccancgcactc

SEQ ID NO: 364733 - DNA, 595 bp, Homo sapiens
  misc_feature: GZ8MTXP02HHLYF.44.38.D05.1.454.CMB.2.raw
  modified_base (296)..(296): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgagtgggagtagcacaagctacgcggactccgagaacggccattcaccatcnccagagacaacgccaaagacacgctgtatcctgacaaaatgaaacagtcaggagacgccgaggacacggctgtagttattacgtgtgacaaaggcggccgggtgcggggtaggttcggggattgctatactactacgtacggtatggacgttcgtacggggaccgaacggggacccgacggtccaccggtcctccgtcacggtcctaccaccgaacgggcccacgttcccgtcccgttcccccgtggccccgcccctgcccgtacggacggaccgtaccgcccgttcggcgggggaccc

SEQ ID NO: 364734 - DNA, 558 bp, Homo sapiens
  misc_feature: GZ8MTXP02IU256.44.38.D05.1.454.CMB.2.raw
  modified_base (374)..(374): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctgggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaaggccattcaccatctccagagacaacgccaagaacacgctgatctgcaaatgaacagtctgagagccgaggacacggctgtgtattactgtgacaagngccgtgcggagtcggggagttgcatactaactactacgtatggacgtcgtaggggaccgaagggaccgaccggtcgaccggtctcctcacgtcctccgacccgaacgggcccaacgttccggtcccgttccccgtcggcccgtcccgtcgccgtccgacggacgccaccgtcggtcggggaccg

SEQ ID NO: 364735 - DNA, 598 bp, Homo sapiens
  misc_feature: GZ8MTXP02HNXH1.44.38.D05.1.454.CMB.2.raw
  modified_base (248)..(248): a, c, t, g, unknown or other
  modified_base (350)..(350): a, c, t, g, unknown or other
  modified_base (387)..(387): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactggtccncaagctccgagggaaggggctggtgtggggtctcacgtattaatagtgatgggatagcacaagctacgcggactcgtgaacgggccattcacatctccaganaccaacgcaagacacgctgtactctgacaaatgaacngtcagagacgcgaggacacgggctggtatattacgtgtagacaaaggcggcccggggttggaccggggtagggtttcggggaagtttggacctagtacctactacgtacgggtattcgggacgttcgtacgggggacccaaaggggtcccacgggttcccaaccggttcctacccgcgacggtcccttacccgaacccgtaacgggccccc

SEQ ID NO: 364736 - DNA, 641 bp, Homo sapiens
  misc_feature: GZ8MTXP02JZ53Z.44.38.D05.1.454.CMB.2.raw
  modified_base (203)..(203): a, c, t, g, unknown or other
  modified_base (303)..(303): a, c, t, g, unknown or other
  modified_base (311)..(311): a, c, t, g, unknown or other
  modified_base (326)..(326): a, c, t, g, unknown or other
  modified_base (335)..(335): a, c, t, g, unknown or other
  modified_base (350)..(350): a, c, t, g, unknown or other
  modified_base (381)..(381): a, c, t, g, unknown or other
tcagacagtatatacacgaccggtgctcgatttagtatctgatagctgggttttccttgttgctattttaaaaggtgtccagtgtgaggtgcagctggtggaggtccggggggaggcttagttcagccgtgggggggtccctgagactctcctgtgcagcctctggattcaccttcagtagctactggatgcacgtgggtccnccaagctccgagggagggctgggtgtgggtctcacgttattaatagtgagtgggagtagcaacaagctacggcggactccgtagaacgggccattcaccntctcaganacaacgccaaagacncgctagtanctgacaaatcgaacngtctagagacgccgaaggacacggtctggtnttacttacgtgtagcgaaaggcgggccgggtaggacggggtaggttcgggggagttgactatactacgtacgtacgtagtcgggacgttcggacggggacgaacgggacccgacggtccaccggtcctcctcgacgtcccgtacccgaccggtaaccggccctacggtcccggttccctttcccccggacggtccccgtcccgttcgaacccgttaccggacgggaccgtaccgtacccggttcggggtcgggggacccg

SEQ ID NO: 364737 - DNA, 569 bp, Homo sapiens
  misc_feature: GZ8MTXP02FP80Y.44.38.D05.1.454.CMB.2.raw
  modified_base (375)..(375): a, c, t, g, unknown or other
  modified_base (386)..(386): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggatagcacaagctacgcggactccgtgaaggccgattcaccatctccagagacaaacgccaaagaacacgctgtatctgacaaaatgaaacagtctagagagccgaggacacggctgtgtattacgngtgacaaaggngcggtggcgggaggttcggggagttgcatactaactacgtacgtagtaggacgtcgtcgggaccgaagggaccgacgtccgaccgtctcctcgagtcctccgaccgaacgggcccacgtccgtccttccccgtcgcccgtcccgtcgccgtccgacggtacgccgaccgtcgtacggggaccg

SEQ ID NO: 364738 - DNA, 651 bp, Homo sapiens
  misc_feature: GZ8MTXP02HE1EW.44.38.D05.1.454.CMB.2.raw
  modified_base (219)..(219): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccattcaccatcnccagagacaacgccaaagaacacgctgtatctgacaaaatgaaacagtctagagacgccgaggacacggctgtgtattactgtgacaaggacgccgggtggcggggtaggtttcggggagttgactacgttactaccctacgtacggttatgggtacgttcgcggggacccaaacggggacccaccgggtaccacccgttcctccgtacgacgtcccgttacccaacccgaacgggcccctacgttcccgttcccgttcccccgtcggcccgtccccgtcgccctccgacgggacgccgtaccgtccgggtcggggccgaccgacggccgggtcccgtcgggccgtcggtcccgtcggtaccgaacggttacctaccgttaccgtacttacgtacttcgtccgtggacggcggtacgtcggaccgaaggccg

SEQ ID NO: 364739 - DNA, 557 bp, Homo sapiens
  misc_feature: GZ8MTXP02JA0HM.44.38.D05.1.454.CMB.2.raw
  modified_base (249)..(249): a, c, t, g, unknown or other
  modified_base (431)..(431): a, c, t, g, unknown or other
  modified_base (441)..(441): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggcgtgtcacaagatttgggctctgggcaccgtgggcatgggggaggcttagttcagcctggggggtccctgagactctcctgtgcagcctctggattcaccttcagtagctactggatgcactgggtccncaagctccaggggaaggggctggtgtgggtctcacgtattaatagtgatgggagtagcacaagctacgcggactccgtagaagggccgattcacctatctccagagaccaacgccaaagaccacgctgtatctgacaaaatgaaacagtctagagagccgaggacacggctgtagtattacngtcgacaagngccggtgcgggtaggttcggggagttgcatacactaacgtacggtatcgggacgtcggtcggggacacgggacctaacggtcaccgtctcctcgacgcctaccgacgaacggtccc

SEQ ID NO: 364740 - DNA, 585 bp, Homo sapiens
  misc_feature: GZ8MTXP02IDI1S.44.38.D05.1.454.CMB.2.raw
  modified_base (364)..(364): a, c, t, g, unknown or other
  modified_base (371)..(371): a, c, t, g, unknown or other
tcagacagtatatacacgaccggtgctcgatttagtatctgatagctgggttttccttgttgctattttaaaggtgtccagtgtgaggtgcagctggtggagtccggggaggcttagttcagcctgggggtccctgagactctcctgtgcagcctctggattcaccttcagtagctactggatgcactgggtccgccaagctccgagggaagggctgggtgtgggtctcacgtattaatagtgatgggatagcaacaagctacgcggactccgtgaaggccattcaccatctccagagacaacgcaaagaacacgctgtatctgacaaaatgaaactgtctgagagccgaggactacggctgtntatctgngacaaagcgcggtggacggtaggttacgggagtgactataactaacgtaacgtagtagtacggtacggtcggacggggaccgaaacgggacccgtacggtcccaccgttctccgtcacgtccgtacccacccgaaccggaccgacgtccgttcccgttccccgtccgtccgtcccgtccgtccgtaccgacgacgaccgaccgtccgtacggcg

SEQ ID NO: 364741 - DNA, 593 bp, Homo sapiens
  misc_feature: GZ8MTXP02JRBST.44.38.D05.1.454.CMB.2.raw
  modified_base (277)..(277): a, c, t, g, unknown or other
  modified_base (294)..(294): a, c, t, g, unknown or other
  modified_base (373)..(373): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaagggctgggtgtgggtctcacgtattaatagtgatgggagtagcacaagctacgcggactcgngaaggccatcaccatcncagagacaacgccaaagaacacgctgtatctgacaaatgaacagtctagagagccgaggacacggctgtgtattactgngacaaggaggccgggtggcggggtaggttcgggggagttgacatacgttaactacgtacggtagtggacgtcgtacgggggaccgaaggggaccgacggtaccgacccgtccgtccgtcgacgtccttacccgacccgaaacgggccccacgttccgggtcccttcccccgtcggcccgccctcgccgtccgacggacgccgaccgtcggtcggggaccg

SEQ ID NO: 364742 - DNA, 586 bp, Homo sapiens
  misc_feature: GZ8MTXP02F08SQ.44.38.D05.1.454.CMB.2.raw
  modified_base (249)..(249): a, c, t, g, unknown or other
  modified_base (309)..(309): a, c, t, g, unknown or other
  modified_base (327)..(327): a, c, t, g, unknown or other
  modified_base (346)..(346): a, c, t, g, unknown or other
  modified_base (351)..(351): a, c, t, g, unknown or other
tcagacagtatatacacgaccggtgctcgatttagtatctgatagttgggtttggggggaagaggaagactgacggtcctcccaggagttcaggtgctgggcaccttgggcacgggggaggtgtgtcacaagatttgggctctgggcaccgtgggcatgggggaggcttagttcagcctgggggtccctgagactctcctgtgcagcctctggattcaccttcagtagctactggatgcactgggtccnccaagctccgaggggaagggctggtgtgggtctcacgtattaatgtgagtgggatagcanaagctacgcggactccgnggaacggccatcaccatcncaganaccaacgccaaagacacgctagtctctgacaaagtgaaacagtctagagacgcgaagacgacgctgtgtattacgtgagacaagaggccgggtagcggggtaggtcggggtagtggactaagttactacgtacgtaggtaacgtcgggtacgttcggacggggaccgaaacggggccccgtaacggtccgaccgtcctcccgtacgtaccggtccttacccgaaccgaccggccc

SEQ ID NO: 364743 - DNA, 628 bp, Homo sapiens
  misc_feature: GZ8MTXP02IWXKI.44.38.D05.1.454.CMB.2.raw
  modified_base (251)..(251): a, c, t, g, unknown or other
  modified_base (312)..(312): a, c, t, g, unknown or other
  modified_base (331)..(331): a, c, t, g, unknown or other
  modified_base (376)..(376): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcagtgggggaggcttagttcagccgtggggggtccctgagactctcctgtgcagcctctggattcaccttcagtagctactggatgcacgtggtccncaagctccgaggggagggctggtgtgggtctcgacgtattaatgtgagtgggagtagacanaagcgtacgcggactccgngaacggccatcaccatctcagacaccaacgcaaagacacgctagntctagacaaagtgaacagtcagagacgccgaaggacacggtctaggtgttaacttacgtgtacgacgaaaggtacggcccgggttgggacggggtagggttaccgggggattcggactaacttaacgtacgtaacgttacgtagtacgggacgttcgggacgggggaacccgaaacggggtcccgtaaccgggttccacccggttctcccgtacgtacggtcccttacccggaacccggtaacgggtccccc

SEQ ID NO: 364744 - DNA, 552 bp, Homo sapiens
  misc_feature: GZ8MTXP02FNVLM.44.38.D05.1.454.CMB.2.raw
  modified_base (413)..(413): a, c, t, g, unknown or other
  modified_base (439)..(439): a, c, t, g, unknown or other
  modified_base (463)..(463): a, c, t, g, unknown or other
  modified_base (501)..(501): a, c, t, g, unknown or other
  modified_base (508)..(508): a, c, t, g, unknown or other
tcagacagtatatacacgaccggtgctcgatttagtatctgatagttgggtttggggggtctcaggaggcagcactctcgggacgtctccaccatggcctgggctctactcctcctcagcctcctcactcagggcacagggtcctggggactgtctacctgactcagccgccctcagtgtccgggactcctggtcagtcggtcaccatcttctgttcttccagcgacaattccactggaccctttaaagctctatcatggtacgcagtggtcccggccgacgccccaaagtcctctttacgacgtccttcgcggcttcggcacgtcctggtccgttttcggcctcagttctgaccacgcggcctcccctgaccatcaccaactccgctgagatgagctgtacttactttgttntgcattatttcgattcactcaaaatntagtcttacggaagtcgggacccngtacagtcgtcctgcgtcacgccaacggcccaaacccntcgtacnccttctccgttcccgccctcctctactacgtctcgtcctagcgg

SEQ ID NO: 364745 - DNA, 626 bp, Homo sapiens
  misc_feature: GZ8MTXP02F6U3C.44.38.D05.1.454.CMB.2.raw
  modified_base (296)..(296): a, c, t, g, unknown or other
  modified_base (367)..(367): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaaggggctggtgtgggtctcacgtattaatagtgatgggagtagcacaagctacgcggactccgtgaaggccattcaccatcncagagacacgccaagacacgctgtatctagacaaaatgaacagtctagagacgccgaggacacggctggtntattactgtgacaaaggcggccgggtggcggggtaggttcgggggagttgactacgtactacgtacgtacggtagtacgggacgtcggtcgggggaccgaacggggacccgacggtccgaccggtcctcccgtacgacgtccgttacccgaaccggaaccgggcccctacgttcccggttcccttcccccggtcggtccccgtccccgttcggcccgttaccgacggtaccgcccgtacccgtccggtcgggggacccg

SEQ ID NO: 364746 - DNA, 587 bp, Homo sapiens
  misc_feature: GZ8MTXP02ISD1Q.44.38.D05.1.454.CMB.2.raw
  modified_base (275)..(275): a, c, t, g, unknown or other
  modified_base (290)..(290): a, c, t, g, unknown or other
  modified_base (493)..(493): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaagggctggtgtgggtctcacgtattaatagtgatgggatagcacaagctacgcggactcgngaaggcatcacatcnccagagacaacgccaagaacacgctagtatctgacaaatgaacagtctagagacgccgaggacacggctggtgtattacgtgtgacaaagggcggccggtggcggggtaggttcgggggagttgactacgtaactactaacgtacggtagtaggtacgtcggtacggggaccgaacgggaccgacggtccgaccgtctcctcncgtacctccaccgaacggcccctacgtccggttcccttccccgtcggcccgtcccgtcgccgtccgacggacgccgaccgttcgcgggggaccg

SEQ ID NO: 364747 - DNA, 645 bp, Homo sapiens
  misc_feature: GZ8MTXP02HS3JB.44.38.D05.1.454.CMB.2.raw
  modified_base (277)..(277): a, c, t, g, unknown or other
  modified_base (297)..(297): a, c, t, g, unknown or other
  modified_base (326)..(326): a, c, t, g, unknown or other
  modified_base (344)..(344): a, c, t, g, unknown or other
  modified_base (361)..(361): a, c, t, g, unknown or other
  modified_base (365)..(365): a, c, t, g, unknown or other
  modified_base (372)..(372): a, c, t, g, unknown or other
tcagacagtatatacacgaccggtgctcgatttagtatctgatagctgggttttccttgttgctattttaaaaggcgtccagtgtgaggtgcagctggtggagtccgggggaggcttagttcagcctggggggtccctgagactctcctgtgcagcctctggattcaccttcagtagctactggatgcactgggtccgccaagctccgagggagggctggtgtgggtctcacgtattaatagtgagtgggagtagcacaagctacgcggactccggnggaaggccgattcaccatcnccagagacaacgccaagaacacgctgtanctgacaaatgaacagtcngagacgcgagacacggntgtntattacngtagacaaaggcggccgggtgggcggggtaggttcgggggtagttgacgtacttaaccgtaacgttacgttacggtagtcgggtacggttcggtacggggaccgaacgggacccgaccggtccgacccgtccttcccgctacgtccttacccgaaacccgtaaccgggaccccgtacgttcccggttccccgttcccccggtcggtccccgtccccgttcgaacccgtcccggaacgggaccgacccgtacccggtccgggtcgggggacccg

SEQ ID NO: 364748 - DNA, 644 bp, Homo sapiens
  misc_feature: GZ8MTXP02HLFY2.44.38.D05.1.454.CMB.2.raw
  modified_base (331)..(331): a, c, t, g, unknown or other
  modified_base (344)..(344): a, c, t, g, unknown or other
  modified_base (363)..(363): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggaagggctgggtgtgggtctcacgtattaatagtgatgggatagcacaagctacgcggactccgtggaaggccatcaccatctccagagacaacgccaaagacacgctgtatctganaaatgaacagtcngagacgccgagacgacggntgtacgtattacgtgtgacaaagggcggccgggtggcggggtagttcgggggagttgacattacgtactacgtacggtagtagggacggttcggtacgggggtacccgaacggggacccgtaccgggtccgacccggttcctcccgtacgaccgtacccgttacccgaaacccggaaccgggtcccctacggttcccggttcccccttcccccgtccgggtcccgtccccgtcggtaacccgtcggaacggccgaccctccggttccgggacggggacccg

SEQ ID NO: 364749 - DNA, 580 bp, Homo sapiens
  misc_feature: GZ8MTXP02F05S8.44.38.D05.1.454.CMB.2.raw
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaaggccgattcaccatctccagagacaacgcaaagacacgctgtatctgacaaatgaacagtctgagacgaccgaggacacggctgtgtattactgtgacaaagcgccgggtgcgggtaggtcggggagttgcatactacgtacgtacgtagtggtacgtcgtacggggaccgaacgggacccgacggtccgaccgtctccgtcgacgtccgttacccaaccgacgggcccacgttccggtcccttcccccgtcggcccgtcccgtcgcccgtccgacggacgccgaccgtcggtcggggaccg

SEQ ID NO: 364750 - DNA, 602 bp, Homo sapiens
  misc_feature: GZ8MTXP02GCGGL.44.38.D05.1.454.CMB.2.raw
  modified_base (317)..(317): a, c, t, g, unknown or other
  modified_base (358)..(358): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtacctatggcatgcactgggtccgccaggctccaggcaaggggctggagtgggtgcacttatatggtatgatggaaagtaataatactatgcagactcgtgaaggcattcacatctcagagacataccaagaacacgctagtanctagacaaatgaacagcctagagacgccgagacaccgggtntagtagttatacgtgtcgacgaagtactaattagttagtaactacctaccacgtgacgtacggtaactacgtaacgtaggtagtcggtacgtcggtacggggaacctaaacggccgtacggtacctacccgtctaccgtacgaccgtaccccgtaccgaaccggtaaccggccctacgttcccgtacccgttccccgacgtaaccccgtacccctaccgaccgacgaccgaccgtaccggtcgg

SEQ ID NO: 364751 - DNA, 567 bp, Homo sapiens
  misc_feature: GZ8MTXP02GYAWB.44.38.D05.1.454.CMB.2.raw
  modified_base (298)..(298): a, c, t, g, unknown or other
  modified_base (556)..(556): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccattcaccatctccagagacaacgccaaagaacacgctgtatctgacaaaatgaaacagtctgagagccgaggacacggctgtgtattacngtgacaagcgccggtggcggggtagtttcggggattgcagtactacctactacggtatggacgtcgtggggccaaaggggccacggtcaccgttctacctcacgcttccaccgaaacgggcccacgtccggtcccttcccccgtcggccgcccctgcctccgaggacgccaccgtcggtgggggccacgacggccggcccgtgggccgtcgcccgtggtcaaaggaccttacttcctatactactgtcgtgacgcggncggcgaaggcg

SEQ ID NO: 364752 - DNA, 622 bp, Homo sapiens
  misc_feature: GZ8MTXP02HN4MM.44.38.D05.1.454.CMB.2.raw
  modified_base (318)..(318): a, c, t, g, unknown or other
  modified_base (326)..(326): a, c, t, g, unknown or other
  modified_base (333)..(333): a, c, t, g, unknown or other
  modified_base (347)..(347): a, c, t, g, unknown or other
  modified_base (350)..(350): a, c, t, g, unknown or other
  modified_base (355)..(355): a, c, t, g, unknown or other
  modified_base (383)..(383): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcagtgggggaggcttagttcagccgtggggggtccctgagactctcctgtgcagcctctggattcaccttcagtagctactggatgcactgggtccgccaagctccgaggggaaggggctgggtgtggggtctcgaacgttataaatagtgagtgggatagcanagctacgngactcgngaaggcattcaccntcncaganaccaacgaccaagacacgctgtatcgtnacaaatgaaacagtcagagacgccgaggacacggctagtgtatacgtgtagacaaaggacggccgggtaggcggggtaagggttcgggggaagttcggactagttaaccgtactaacgtacgggtaagttcggaacggtttcggacggggacccgaaagggaccccgtaacgggtccctaacccggttcctacccgtactaccggtacctttaccccgaaaccgttaaccggggccccc

SEQ ID NO: 364753 - DNA, 576 bp, Homo sapiens
  misc_feature: GZ8MTXP02JWCHW.44.38.D05.1.454.CMB.2.raw
  modified_base (455)..(455): a, c, t, g, unknown or other
tcagacagtatatacacgaccggtgctcgatttagtatctgatagttgggtttgggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccggccgagcccccaaagtcctctttacgacgtcctttcgcgggtcttcggcacgtccctggtccgtttttcggcccttcctagttctgacctacgccggcctccccctgaccatccaccaaactccggcctgagatgagctgacttacttttgtgtgctatatttcgattcactcaaatntgtcttcggaagtgggacccgcgtcacgtcgtcctgcgtcacgaccccgaaacggcccaaaaccccgctacgccaaccttcctcgttcccccgcccttcctactactctactcgtctgcgg

SEQ ID NO: 364754 - DNA, 595 bp, Homo sapiens
  misc_feature: GZ8MTXP02GKG6K.44.38.D05.1.454.CMB.2.raw
  modified_base (274)..(274): a, c, t, g, unknown or other
  modified_base (290)..(290): a, c, t, g, unknown or other
  modified_base (336)..(336): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccgagggaagggctggtgtgggtctcacgtattaatagtgatgggatagcacaagctacgcggactccgngaaggccatcacatcncagagacaacgccaagaacacgctgtatctgacaaatgaacagtcngagacgccgaggacacggctgtagtattacgtgtagacaaagggacgccgggtggacggggtagggttcgggggagttgacagttaacgtaacgtaacgtacggtagtacgggacgtcggtcggggaccgaacgggaccgacggtaccgaccgtctccgtcacgtcctcccgaaccgaacgggcccacgttccggtcccgttcccccgtcggcccgtcccgtcgccgtccgacggacgccgaccgtcggtcgggggccg

SEQ ID NO: 364755 - DNA, 712 bp, Homo sapiens
  misc_feature: GZ8MTXP02JZ6PQ.44.38.D05.1.454.CMB.2.raw
  modified_base (198)..(198): a, c, t, g, unknown or other
  modified_base (276)..(276): a, c, t, g, unknown or other
  modified_base (289)..(289): a, c, t, g, unknown or other
  modified_base (292)..(292): a, c, t, g, unknown or other
  modified_base (297)..(297): a, c, t, g, unknown or other
  modified_base (329)..(329): a, c, t, g, unknown or other
  modified_base (333)..(333): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccgagggaagggctggtgtgggtctcacgtattaatagtgagtgggagtagcacaagctacgcggactcgngaaggccatcacntcncaganacacgcaagacagctgatctgacaaatgaacngtcngagcgaccgaggacacggctgtagtacttacgtgtgacgaaagcggccgggtgggacggggtacgggtttacgggggtagtttgacgtagttaaaccttaaccgttaaccgttaaccgggttaagtacgggtaccggttcggtacgggggacccgaaacgggggaccccgtaaacggtcccgtaccccggttcctccccgtacgtaccgtcccttaccccgaacccgtaacccggggtacccccgtacggttcccccgggtttccccgtttcccccccggtaccgggtcccccgtcccccgttaccggtccccgttacccccggaacggggtacccgacccgtaccccggtttcccggggtaccggggggtaacccccg

SEQ ID NO: 364756 - DNA, 545 bp, Homo sapiens
  misc_feature: GZ8MTXP02G97UW.44.38.D05.1.454.CMB.2.raw
  modified_base (291)..(291): a, c, t, g, unknown or other
  modified_base (336)..(336): a, c, t, g, unknown or other
  modified_base (367)..(367): a, c, t, g, unknown or other
  modified_base (375)..(375): a, c, t, g, unknown or other
tcagacagtatatacacgaccggtgctcgatttagtatctgatagctgggttttccttgttgctattttaaaaggtgtccagtgtgaggtgcagctggtggagtccggggaggcttagttcagcctgggggtccctgagactctcctgtgcagcctctggattcaccttcagtagctactggatgcactgggtccgccaagctccgagggaagggctgggtgtgggtctcacgtattaatagtgatgggatagcacaagctacgcggactccgtgaaggccattcacatcncagagacaacgccaagacagctgtatctgacaaatgaaacagtcngagagccgaggacacggctgtgtattactgngacaaagngccggtgcggggtagtcggggagttgcagtactactacgtacggtagtggacgtcgtggggaccaaggggaccacggtccaccggtctccgtcagtcctcaccgaacgggcccagtccggtcttccccgtcggccgcctcgcctcgacgacgccgaccgtcgcggggccg

SEQ ID NO: 364757 - DNA, 564 bp, Homo sapiens
  misc_feature: GZ8MTXP02GDOIJ.44.38.D05.1.454.CMB.2.raw
  modified_base (248)..(248): a, c, t, g, unknown or other
  modified_base (308)..(308): a, c, t, g, unknown or other
  modified_base (410)..(410): a, c, t, g, unknown or other
tcagacagtatatacacgaccggtgctcgatttagtatctgatagttgggtttgggggaagaggaagactgacggtcctcccaggagttcaggtgctgggcaccttgggcacggggaggtgtttcacaagatttgggctctgggcaccgtgggcatggggaggcttagttcagcctggggggtccctgagactctcctgtgcagcctctggattcaccttcagtagctactggatgcacgtgggtccnccaagctccgagggaaggggctggtgtgggtctcacgtattaatagtgatgggatagcanaagctacgcgactccgtgaaggccatcaccatctcagagacacgaccaaagaacacgctagtatctgacaaaatgaacagtcagagagccgagacaggctgngtattactgtagcaagagccggtggcgggagttcgggggattcggctatactaactacgtaacggtagtcggacgtcgtagggaccaaaggggacccacggtaccacccggtctaacctacgacgtacctccgaacccgaacgggaccctacgg

SEQ ID NO: 364758 - DNA, 579 bp, Homo sapiens
  misc_feature: GZ8MTXP02FH1P7.44.38.D05.1.454.CMB.2.raw
  modified_base (172)..(172): a, c, t, g, unknown or other
  modified_base (292)..(292): a, c, t, g, unknown or other
  modified_base (323)..(323): a, c, t, g, unknown or other
  modified_base (334)..(334): a, c, t, g, unknown or other
  modified_base (338)..(338): a, c, t, g, unknown or other
  modified_base (342)..(342): a, c, t, g, unknown or other
  modified_base (369)..(369): a, c, t, g, unknown or other
tcagacagtatatacacgaccggtgctcgatttagtatctgatagctgggttttccttgttgctattttaaaaaggtgtccagtgtgaggtgcagctggtggagtccggggaggcttagttcagcctggggggtccctgagactctcctgtgcagcctctggattcaccttnagtagctactggatgcactgggtccgcaagctccgagggaagggctggtgtgggtctcacgtattaatagtgatgggatagcacaagctacgcggactccgtgaagggccatcaccatcnccagagacaacgccaaagacacgctgtatcngcaaatgaacngtcngagngccgagacacggctgtgtattactgtnacaaaggtcgccgggtggcggggtaggttcggggagttgacattactaactacgtacggtagtaggacgtcgtacggggaccgaacgggtacccgacggtccaccgtcctccgtcgacgccttacccgaaccgaacgggccccacgtcccggtccttcccccgtcggcccgccctcgcctccgacggacgccaccgtcgtcgggggaccg

SEQ ID NO: 364759 - DNA, 574 bp, Homo sapiens
  misc_feature: GZ8MTXP02HGB9B.44.38.D05.1.454.CMB.2.raw
  modified_base (291)..(291): a, c, t, g, unknown or other
  modified_base (296)..(296): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgcaagctccgagggaagggctggtgtgggtctcacgtattaatagtgatgggagtagcacaagctacgcggactccgtgaaggccatcacatcncaganacaacgccaagaacacgctgatctgacaaatgaacagtctagagacgccgaggacacggctgtgtattacgtgtgacaaggacggccggtggcggggtaggttcggggagttgacatactactacgtacgtatggacgtcgcgggacgaagggaccgacggtccaccgtctcctcgcgtcctaccgaacccgaacggacccgtacgtcccggttcccttcccccgtcggcccgtcccgtcgtccgtccgacgcggacctacccgtcgtcgggggaccg

SEQ ID NO: 364760 - DNA, 771 bp, Homo sapiens
  misc_feature: GZ8MTXP02HH0R7.44.38.D05.1.454.CMB.2.raw
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggagggctggtgtggtctcacgttattaatagtgagtgggagtagcaacaagctacggcggactccggtaggaacggccgattccaccatcctccaagacgaccaaacgccaaagaaccacgctagtactctagactaaaatcgaaacaggtctaggagacgacccggaaggaccgaacgggtctggtagttacttacgtcggtgacgaaaggtcggccgggtgggccggggtagggtttcgggggagttcggacgtaacttaaccgtaacgttaaccgtaaccgggtagttacggggaccggttccgggtacgggggtaacccggaaaccggggtacccgtaccgggtacccgaaccccggttccgtaccccgtccgtaaaccgtccccgtttaaccccgaaccccggtaaaacccggggtccccctaaaccggtttcccccgggttaccccgtttcccccccggtcggggtcccccgttccccgtccgggtccccgtaccccggacggggtaacccgcccggtaaccccggtttccggggtaccgggggaacccgg

SEQ ID NO: 364761 - DNA, 662 bp, Homo sapiens
  misc_feature: GZ8MTXP02GPTCE.44.38.D05.1.454.CMB.2.raw
tcagacagtatatacacgaccggtgctcgatttagtatctgatagttgggtttgggggaagaggaagactgacggtcctcccaggagttcaggtgctgggcaccttgggcacgggggaggtgtttcacaagatttgggctctgggcaccgtgggcatgggggaggcttagttcagcctggggggtccctgagactctcctgtgcagcctctggattcaccttcagtagctactggatgcacgtgggtccgaccaagcctccgaggggaaggggctggtgtgggtctcgacgttattaagtagtgagtgggagtagcaacaagctacgcggactccggtggaacggccgtattccaccatctaccagacgaccaaccgaccaaagaacacgctgtactctagacaaatcgaaacagtctagagacgaccgaaggaccacggcttggtacgttaattacgtgtacgacgaaaggcggtccgggtgggacggggtagggttcgggggagttcgactaacgttactaacgttaacgtacgggtatcggggtaacgtcggtacgggggaccgtaaacggggacccgtacggtacccgtacccgttccgtaaccccgtacgtacggtacccttacccgaaacccggtaaccgggtaccccttaccggg

SEQ ID NO: 364762 - DNA, 584 bp, Homo sapiens
  misc_feature: GZ8MTXP02HU81M.44.38.D05.1.454.CMB.2.raw
  modified_base (300)..(300): a, c, t, g, unknown or other
tcagacagtatatacacgaccggtgctcgatttagtatctgatagctgggttttccttgttgctattttaaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaaggccgatcacatctcaganacaacgccaagaacacgctgtatctgacaaatgaacagtctgagacgcgaggacacggctgtgtattactgtgacgaagcggccggtggcggggtaggtcggggagttggactagttactacgtaacgtacgtagtaggacgtcggtacggggaccgtaagggaccgacggtcgacccgtctcctcacgtctaccgaaccgacggacctacgtccgttacccttccccgtcggcccgtccctcgccgtccgacggtacgccgtaccgtccggtacggggacccg

SEQ ID NO: 364763 - DNA, 611 bp, Homo sapiens
  misc_feature: GZ8MTXP02JMOXW.44.38.D05.1.454.CMB.2.raw
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccggtgaacggccattcaccatcctccagagaccaacgaccaaagaaccagctgtatctagacaaaagtgaaactagtctagagacgcccggaaggaccacggctgtgtacttacgtgtgacaaaggcggccgggtggacggggtagggttcggggagttcgactacgtactaacgtacgtacggtagtacgggacgtacggtcggggaccgaacgggaccgaaccggtccacccgttctccgtcacgtccgttccgaaccgacgggccctacgtccggtcccttccccgtcggccgtcccgtcgccgtaccgacggacgccgtccgtcggacggggcc

SEQ ID NO: 364764 - DNA, 586 bp, Homo sapiens
  misc_feature: GZ8MTXP02I5JXM.44.38.D05.1.454.CMB.2.raw
  modified_base (452)..(452): a, c, t, g, unknown or other
  modified_base (476)..(476): a, c, t, g, unknown or other
tcagacagtatatacacgaccggtgctcgatttagtatctgatagttgggtttggggggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatgtacgcagtggtcccggccgagcccccaaagtcctcttttacgacgtcctttcgcgggcttcggcagtccctggccgtttttcggcctcccagttctgaccacgcggcctccccctgacccatccaccaaaacctcccggcctgaggatgaggctgactattttgtgtgcatatttcgattcactcaaatntgtcttcggaagttgggaccccgngttcagtcgtcctgcgtcagtccccgaaaggcccaaacccccgacttcggtactaccttccgtcgttcccccgtcccttcccgtccttactacacttgtacctggtacgg

SEQ ID NO: 364765 - DNA, 786 bp, Homo sapiens
  misc_feature: GZ8MTXP02HMJ7U.44.38.D05.1.454.CMB.2.raw
  modified_base (361)..(361): a, c, t, g, unknown or other
  modified_base (364)..(364): a, c, t, g, unknown or other
  modified_base (369)..(369): a, c, t, g, unknown or other
tcagacagtatatacacgaccggtgctcgatttagtatctgatagttgggtttggggggaagaggaagactgacggtcctcccaggagttcaggtgctgggcaccttggggtacgggggaggtgtgtcacaagatttgggctctgggcaccgtgggcagtgggggaggcttagttcagccgtgggggtccctgagactctcctgtgcagcctctggattcacctttcagtagctactggatgcacgtcgggtccgaccaagcctaccggaggggacggggctgggtggtgggtctcacgttaattaataggtgagtgggagtagcaacaagctacggcggactcggtagaacggcatcacntcncaganacaaccgaccaaagacacgtctagtactcgtagaactaaaagtacgaaactacgtactaggaaaggaccgacccgggaaaggaacccgacgggtctttaggttagttaactttacgtggtacgaacgaaaacgggtcggtcccgggggttagggtacgggggttaacgggtttcgggggaagtttcggaaccttaaagttaacccgttaaacggttaaccggtttaaacggggtcgttaccgggggttaaaccgttccgggggttaaccgggggaaacccccgtaaaacggggggaacccccttaaccgggggttacccctaacccccggggtttcctaacccccggttacgtaacccggttacccccgtttaacccgaaaaccccggggaaacccggggttccccttaacccgggg

SEQ ID NO: 364766 - DNA, 615 bp, Homo sapiens
  misc_feature: GZ8MTXP02JQX17.44.38.D05.1.454.CMB.2.raw
  modified_base (262)..(262): a, c, t, g, unknown or other
  modified_base (284)..(284): a, c, t, g, unknown or other
  modified_base (302)..(302): a, c, t, g, unknown or other
tcagacagtatatacacgaccggtgctcgatttagtatctgatagttgggtttgggggtccctgagactctcctgtgcagcctctggattcaccttcagtagctactggatgcactgggtccgccaagctccagggaagggctgggtgtgggtctcacgtattaatagtgatgggagtagcacaagctacgcggactccgtgaaggccattcaccatctccagagacaacgccaagaacacgctgtatctgcaaaatgaacngtctgagagccgaggacacggntgtgtatactgtgcaagngccggtgcggggagttcggggattgctatactacctacgtacggtatgggacgtcgtggggccaagggccacggtcaccgtctccctacacgtccttacccaccgtaacggggccccaacgttccggttcccttcccccgtggcccgcccccgttgccccgttccgacggacgccctaacccgtcgggtacgggggccaaccgcggcccggtccccgtgggccgtcgcccgtcggtaccgaacggtaccttaaccgttccgtaacttactcgttacggtcgtacggacggtccggcgtcgggaccgaaggccg

SEQ ID NO: 364767 - DNA, 688 bp, Homo sapiens
  misc_feature: GZ8MTXP02IKV0Z.44.38.D05.1.454.CMB.2.raw
  modified_base (380)..(380): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagcccaccctcagtgtcagtggccccaggaaagacggccaggattaccgtggtagggggaaacaacattaggaagtaaaagtgtagcactggtaccagcagaagccaggccaggcccctgcgctggtcatctattatgatgccgaccggccctcgaggggtactcccgtagacgcgtacttcgtcgtggcctccgaactcgtacggggaaccnccgggccacccgtgacccatcgagcgagggtacgaacggcccggggatacggacgggaccgaacgttacgttaacgtcggtacgtagggtggttaaggggaattaagggttaaggttaggtggtaacgttcggaacggttcgggggttacgggttaccggggacggggtaacggggaccccgaaaaggtccgtaacggtaccccggtaccgttaacgggacctaccggacccccgaaagggtcccgtaacccggtccccccgtacgggtaccctaccggttcccgttccgggttacccccgtcccccg

SEQ ID NO: 364768 - DNA, 609 bp, Homo sapiens
  misc_feature: GZ8MTXP02FQPMM.44.38.D05.1.454.CMB.2.raw
  modified_base (124)..(124): a, c, t, g, unknown or other
  modified_base (271)..(271): a, c, t, g, unknown or other
tcagacagtatatacacgaccggtgctcgatttagtatctgatagttcagcctggggggtccctgagactctcctgtgcagcctctggattcaccttcagtagctactggatgcactgggtccnccaagctccagggaagggctggtgtgggtctcacgtattaatagtgatgggatagcacaagctacgcggactccgtgaagggccattcaccatctccagagacaacgccaaagaacacgctgtatctgcaaaatgaacagtctgagngccgaggacacggctgtgtattactgtgcaagacgccgggtggcgggtagttcggggagttgcagtactactacgtacggtatgggacgtcgtgggggaccaaaggggacccacggtccaccgtctcctcgacgccttccaaccgaacgggccccacgttccggtccccttcccccgtggcccgtcccgtcgccgtaccgaggacgaccgtaccgtccggtcgggggccaacgcggcccggcccggtcgggcgtcggaccggttcggtaccgaaacggtaccttacgttccctaagttacttaacgtcgtacgtcggacgtccgggtacgtcgggacg

SEQ ID NO: 364769 - DNA, 623 bp, Homo sapiens
  misc_feature: GZ8MTXP02HX5SZ.44.38.D05.1.454.CMB.2.raw
  modified_base (292)..(292): a, c, t, g, unknown or other
  modified_base (381)..(381): a, c, t, g, unknown or other
  modified_base (486)..(486): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagcccaccctcagtgtcagtcggccccaaggaaagacggccaggattaccgtggtagggggaaacaacattaggaaagtaaaagtgtgcacgtggtaccagcagaagccaggccacggcccctgngcgtggtcatctaattatgatacgccgaccggccctcgacgggactcccgtgacgcgattctccgtgcctaccaactcgtacgggaacnccgggcccaccctcgacccagtcagcgaggggtccgaaagggccggggatcggaacggccgaacttacgtacgtgtacgaggtaggtggggtaataggtagtagngtatcgtaggtcggggttggtcgggacgggaacgggaccgaaggtcgtacggtacccggtacgtacgggtcacggacccgtaacggccgtcccgtcccccgttcggtcctaccgtccgttccgttcccccggtcccc

SEQ ID NO: 364770 - DNA, 577 bp, Homo sapiens
  misc_feature: GZ8MTXP02HSWWK.44.38.D05.1.454.CMB.2.raw
  modified_base (277)..(277): a, c, t, g, unknown or other
  modified_base (339)..(339): a, c, t, g, unknown or other
  modified_base (372)..(372): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgngaaggccattcaccatctccagagacaacaccaagaacacgctgtatctgacaaatgaaacngtctgagagccgaggacacggctgtgtattacngtgacaagcgccggtgcgggagttcggggagttgacatactactacgtacggtatggacgtcggtcggggaccgaagggaccgacggtccgaccgtccgtcctcacgcctccgaacccgaacgggccctacgtccggtcccttcccccgtcgggcccgcccgtcgcccgtccgacggacgaccgacccgtcggtcgggggacccg

SEQ ID NO: 364771 - DNA, 576 bp, Homo sapiens
  misc_feature: GZ8MTXP02FHRQQ.44.38.D05.1.454.CMB.2.raw
  modified_base (292)..(292): a, c, t, g, unknown or other
  modified_base (368)..(368): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggctgggtgtgggtctcacgtattaatagtgatgggatagcacaagctacgcggactccgtgaaggccatcaccatcnccagagacaacgccaagacacgctgtatctgacaaaatgaacagtctgagagccgaggacacggctgtgtattacngtgcaaagagccggtggcgggagttcggggagttgcatactactactacgtagtggacgtcgtcgggggaccgaacggggaccgacggtccgacccgtctcccgtcacgtccttaccgaacccgaacgggccccacgttccggtcccttcccccgtcggcccgtccccgtcgccgtccgacggacgccgacccgtcgtcgggggaccg

SEQ ID NO: 364772 - DNA, 722 bp, Homo sapiens
  misc_feature: GZ8MTXP02H34XZ.44.38.D05.1.454.CMB.2.raw
tcagacagtatatacacgaccggtgctcgatttagtatctgatagctgggttttccttgttgctattttaaaaaggtgtccagtgtgaggtgcagctggtggagtccgggggaggcttagttcagcctggggggtccctgagactctcctgtgcagcctctggattcaccttcagtagctactggatgcacgtgggtcccgcaagctccgagggaagggctggtgtgggtctcacgttaattaatagtgagtgggagtagcaacaagctacggcggactccgtggaacggccgattcaccatctccaagagaacaacgaccaaagaaccacgctagtactctagacaaatacgaactagtctagagacgaccgaaggaccgacggcttggtacgttaatttaccgtggtgacgaaaggtacgggcccgggtggccgggggttagggttcggggaggttcgacgtaacgttaacttaacgtaacgtaggtagtcgggtacgtcggtacggggacgaacgggtaccgaccggtaccgtacccgttccttacccgacgtaccgtaccgttaccccgaaaacccgtaaccgggtaccccgttaaccggttccccggtttacccccgttaccccccggtttcgggcccccggttacccccgttccggcccgttacccggaacggtacccggaccgtacccccggttccggggtacgggggaaccccg

SEQ ID NO: 364773 - DNA, 604 bp, Homo sapiens
  misc_feature: GZ8MTXP02IUG4Z.44.38.D05.1.454.CMB.2.raw
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggagggctggtgtgggtctcacgtattaatagtgatgggagtagcacagctacgcggactccgtgaaggccatcaccatctccagagacacgaccaagaacacgctgtatctagacaaatgaacagtctagagagccgagacgacggctgtagtattactgtgacaaggacgtccgggtggcggggtaggttcggggagttgactactacgttactaacgtacggtagttacggtacggtcggtcggggacgaacgggaccgtaccggtcgaccgtctcctcacgtacctaccgaacccgtacgggccctacgtcccgttcccgttcccccgtcggcccgtccccgtcgtccgtaccgacggaccgtaccgacccgttcggtaccgggggaccg

SEQ ID NO: 364774 - DNA, 737 bp, Homo sapiens
  misc_feature: GZ8MTXP02F9TMG.44.38.D05.1.454.CMB.2.raw
  modified_base (322)..(322): a, c, t, g, unknown or other
  modified_base (476)..(476): a, c, t, g, unknown or other
tcagacagtatatacacgaccggtgctcgatttagtatctgatagttgggtttggggggaagaggaagactgacggtcctcccaggagttcaggtgctgggcaccttgggcacgggggaggtgtgtcacaagatttgggctctgggcaccgtgggcatgggggaggcttagttcagccgtggggggtccctgagactctcctgtgcagcctctggattcaccttcagtagctactggatgcacgtcgggtccacaagctccgaggggaaggggctgggtgtgggtctacacgttaattaaatggtgagtgggagtagacaanaagctacgcggactccgaggaacgggcctaattcaacctactccacgaagacgaaccaaccgaccaaagaaccacgtctacgtatccgagtaaaccaaaatacgaaactagttacgagaacgacggacccgggaaaggaaccgaaccggggttntacgttaagttaacgttacgtaggtacgaaacggtaaacggccggggtccgggtaggggtacgggggttaagggttacggggagtttcgaacttaaacgttaccgtaaccggttaacggttacggtaacggtccggggtacgttccggggtaaccggggaaacccgtaaacgggggtaccccttaaccgggtccctaaacccggttccctacccgtaacgtaccggttacccctaacccggaaacccggaaccggttcccc

SEQ ID NO: 364775 - DNA, 654 bp, Homo sapiens
  misc_feature: GZ8MTXP02IITL1.44.38.D05.1.454.CMB.2.raw
  modified_base (261)..(261): a, c, t, g, unknown or other
  modified_base (276)..(276): a, c, t, g, unknown or other
  modified_base (289)..(289): a, c, t, g, unknown or other
  modified_base (291)..(291): a, c, t, g, unknown or other
  modified_base (296)..(296): a, c, t, g, unknown or other
  modified_base (371)..(371): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggaagggctggtgtgggtctcacgttattaatgtgagtgggatagcanagctacgcgactcgngaaggcatcacancncaganacacgacaagaacacgctagtatcgtgacaaagtgaaactgtctagaagcgaccgaggaccacgggtctgggttnttaattacgtgtacgacgaaaggtacggcccggggtggcggggtaggttcgggggtagttcgactaacgttaaccttaacgtaacgtacggtagtacgggtacgtcggtacggggaccgaacgggaccgaccggtccaccggtcctcctacgacgtaccgtaccgaacccggaaacggggtccctaccggttcccggttccccttacccccggtcgggtccccgtcccgtacggcccgttaccgacgggacgtacccgtaccggttccgggacgggggacccg

SEQ ID NO: 364776 - DNA, 656 bp, Homo sapiens
  misc_feature: GZ8MTXP02JE6DE.44.38.D05.1.454.CMB.2.raw
  modified_base (322)..(322): a, c, t, g, unknown or other
  modified_base (356)..(356): a, c, t, g, unknown or other
  modified_base (367)..(367): a, c, t, g, unknown or other
  modified_base (376)..(376): a, c, t, g, unknown or other
  modified_base (454)..(454): a, c, t, g, unknown or other
tcagacagtatatacacgaccggtgctcgatttagtatctgatagttgggtttggggggaagaggaagactgacggtcctcccaggagttcaggtgctgggcaccttgggcgacggggggaggtgtgtcacaagatttgggctctgggcaccgtgggcagtgggggaggcttagttcagccgtggggggtccctgagactctcctgtgcagcctctggattccaccttcagtagctactggatgcacgtcgggtccgccaagctccggaggggaggggctgggtgtgggtctcacgtattaatagtgagtgggatagacaanagctacgcgactccgtgaacggccattcacatcncagacaccacnccaaagacncgactgtactctagacaaatcgaaactagtctagagacgacccggaaaggaccgacgggtctaggtagttacttacgngtacgaacgaaaggacgggtcccggggtagggtacgggggtacggggtttaccgggggaaggtttcgaaccgtaacttaaccgtaacgttacggtacggtaagtcgggacgttcggtacgggggaccctaacggggaccctaacggggtccaacccggtctcccgtacgccgtacccttacccgaaccggtacggtaccccg

SEQ ID NO: 364777 - DNA, 715 bp, Homo sapiens
  misc_feature: GZ8MTXP02GHBD2.44.38.D05.1.454.CMB.2.raw
  modified_base (259)..(259): a, c, t, g, unknown or other
  modified_base (276)..(276): a, c, t, g, unknown or other
  modified_base (291)..(291): a, c, t, g, unknown or other
  modified_base (297)..(297): a, c, t, g, unknown or other
tcagacagtatatacacgaccggtgctcgatttagtatctgatagctgggttttccttgttgctattttaaaaggtgtccagtgtgaggtgcagctggtggaggtccgggggaggcttagttcagcctggggggtccctgagactctcctgtgcagcctctggattcaccttcagtagctactggatgcactgggtccgccaagctccgaggggagggctggtgtgggtctcacgtattaatagtgagtgggatagcanaagctacgcgactccgngaaggcatcacatcnccaganacaacgccaagaacacgctgtaactctagacaaaatgaaacagtctaggagacgacccggaaggaccacggtctggtgttaacttacgtggtgaccgaaaggcggccgggtgggacggggtagggttcgggggtagttacggactaagttaaccttaacgttaacgttacggtagtacggggtaaccgtcgggttacggggaacccggaaacggggaacccggtaacgggttacccgaccccggttaccttacccgtccgtaacgtccctttacccgaaaccccggaaaccggggtacccccgtacggttccccggtttccccgttaccccccggtccggggtcccccgtcccgttccgtcccgttacccgaacggggtaccggacccgtacccggttccggggtcgggggaaccccg

SEQ ID NO: 364778 - DNA, 573 bp, Homo sapiens
  misc_feature: GZ8MTXP02HPL7Y.44.38.D05.1.454.CMB.2.raw
  modified_base (303)..(303): a, c, t, g, unknown or other
  modified_base (358)..(358): a, c, t, g, unknown or other
  modified_base (388)..(388): a, c, t, g, unknown or other
tcagacagtatatacacgaccggtgctcgatttagtatctgatagttgggtttggggtccctgagactctcctgtgcagcctctggattcaccttcagtagctactggatgcactgggtccgccaagctccagggaagggctggtgtgggtctcacgtattaatagtgatgggagtagcacaagctacgcgactccgtgaaggccattcaccatctccagagacaacgccaaagaacacgctgtatctgcaaaatgaacagtctgagagcccgaggacacggctgtgtattactgtgcaaagngccggtgcggggatttcggggagttgcatactaactactacggtatggacttcgnggggccaaagggccacggtcaccgtctccncacgtctccaccgaacggcccacgtccgtccctcccccgtggcccgtccctcgccgtccgaggacgccacccgtcggtcggggaccacgacggccggtcccgtggcgtcgcccgtacggtaccgaaacggtactaccttactaactacttactcgtcgtaggacggtcggcgtcggacgaacgcg

SEQ ID NO: 364779 - DNA, 669 bp, Homo sapiens
  misc_feature: GZ8MTXP02H6QGZ.44.38.D05.1.454.CMB.2.raw
  modified_base (300)..(300): a, c, t, g, unknown or other
  modified_base (486)..(486): a, c, t, g, unknown or other
  modified_base (494)..(494): a, c, t, g, unknown or other
  modified_base (500)..(500): a, c, t, g, unknown or other
  modified_base (542)..(542): a, c, t, g, unknown or other
tcagacagtatatacacgaccggtgctcgatttagtatctgatagttgggtttgggggaagaggaagactgacggtcctcccaggagttcaggtgctgggcaccttgggcacggggggaggtgtgtcacaagatttgggctctgggcaccgtgggcagtggggagcttagttcagccgtgggggtccctgagactctcctgtgcagcctctggattcaccttcagtagctactggatgccacgtgggtccgcaagctccgaggggaaggggctggtgtggggtctcgaacgttattaaanaggtgagtagggacgtagacaacgaagtcgtaccggcggacctcggtacggaaacggggcctacttaccaacctatccgtaccgaagaacgaacccaaaccggacctaaaggaaaccacgtcctagttactccgtagaaaccaaagttcgaaaactgttacagacgacgaccgacggactaccggnttaagggnttaacngtagtgacctaaaggcgccgggttgacgggtaggttacgggnttacgataacgtaacgtactacgtacggtaatcggaacggtcgtacggaaccgtacggtaaccgcggtaccctaaccgttcgcccgttaaacgccgttaaccttacccgaacggaaacggtttcccc

SEQ ID NO: 364780 - DNA, 623 bp, Homo sapiens
  misc_feature: GZ8MTXP02F1OG6.44.38.D05.1.454.CMB.2.raw
  modified_base (199)..(199): a, c, t, g, unknown or other
  modified_base (277)..(277): a, c, t, g, unknown or other
  modified_base (347)..(347): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccnccaagctccgaggggaagggctgggtgtgggtctcacgttattaatgtgagtgggatagcacagctacggcgactcgnggaacggccattccacatcctccagacgacaacgaccaagaacacgctagtatctagactaaatcgaacngtcgtagagacgccgaggacacggtctgtagtattacgtgagacgaaaggcggccgggtggcggggtaggttcgggggagttgactacgtaactaacgttacgtacggtagtacgggtaccgtcggtcggggaccgaacgggacccgacgtcccgaccgtctccgtcgacgtcctaccgaccgaaccgggccacgtcccggtacccttccccgtcggccccgtacccgtcgccgtaccggacggtaccgacccgtaccggtccggacgggggaccc

SEQ ID NO: 364781 - DNA, 648 bp, Homo sapiens
  misc_feature: GZ8MTXP02IKVWA.44.38.D05.1.454.CMB.2.raw
  modified_base (298)..(298): a, c, t, g, unknown or other
  modified_base (354)..(354): a, c, t, g, unknown or other
  modified_base (366)..(366): a, c, t, g, unknown or other
  modified_base (479)..(479): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactgggtccgccaagctccgaggggaaggggctggtgtgggtctcacgtattaatagtnatgggatagcaacaagctaacgcggactccggtgaagggccattcacatctcaganaccaacgccaanaacagctgtactctagacaaaagtgaacagtcagagagccgagacacggctgtagtattacgtgtgacgtaaagacggcccgggttaggaccgggggtagggttaccgggggnggtttacgaccgtaatacctaacgttaacgtacgggttaagtcgggtacggttaccggtacgggggaacccgaaacgggggaccctaaccggggttaccaacccggttccctcccgttacccgacggtacccgtttacccccgaacccggttaaaacggggtccccccg

SEQ ID NO: 364782 - DNA, 676 bp, Homo sapiens
  misc_feature: GZ8MTXP02IL2XA.44.38.D05.1.454.CMB.2.raw
  modified_base (249)..(249): a, c, t, g, unknown or other
  modified_base (354)..(354): a, c, t, g, unknown or other
  modified_base (376)..(376): a, c, t, g, unknown or other
  modified_base (398)..(398): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagcctggggggtccctgagactctcctgtgcagcctctggattcaccttcagtagctactggatgcactgggtccncaagctccgagggagggctggtgtggtctcacgtattaatgtgagtgggatagacacaagctacgcggactccggtaggaacggccattccaccatcctacaganaccccaacgccaaagaacacgntgtatctagacaaatccgaaanacggtctagagacgaccggaggaccgacggtctgttagttaaactttcgaggcgacaaacgggtcggcccggggtggacgggggtacgggtttaccgggggagttccggactaacgtaaccgttaacttaaccggtacgttaggtacgggacccgtttcgggacgggggaaacccctaaacggggcccccgtaaacggggttccctaaacccggggttccttccccgtaacggtacccttacccggtttacccccaacccgggtaaaccggttccccc

SEQ ID NO: 364783 - DNA, 709 bp, Homo sapiens
  misc_feature: GZ8MTXP02GIT0K.44.38.D05.1.454.CMB.2.raw
  modified_base (249)..(249): a, c, t, g, unknown or other
  modified_base (447)..(447): a, c, t, g, unknown or other
  modified_base (473)..(473): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatgggggaggcttagttcagccgtgggggtccctgagactctcctgtgcagcctctggattcaccttcagtagctactggatgcactgggtccncaagctccgaggggagggctggtgtgggtctcacgttattaagtagtgagtgggatagcagaagctacggcggtactccggtaggaacgggccgattccacctatcctaccagacgacccaaccgaccaaagaaccacgacttagtactctagacctaaaagtcgaaactgtcaaggagacggcccgaaaggaacccncgggtacttggtagttaacttacggngtacgaacgtaaaggccgggtcgggtagggacggggttagggttacggggagtttcgaacgttaaacgttaaccgtaaccgttaacggttaacggggtacgtaacggggtacggtttaccggggtacggggaacccggaaacggggttaccccgaaccggttaccctaacccgggttccttaacccggtacgtaccggtttaccccgttacccggaaaccggtaaccgggtccccg

SEQ ID NO: 364784 - DNA, 773 bp, Homo sapiens
  misc_feature: GZ8MTXP02IQX7L.44.38.D05.1.454.CMB.2.raw
  modified_base (370)..(370): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggaaggggctgggtgtgggtctcgacgtattaagtagtgagtgggatagcacaacgctacggcggactccggaggaacggccgtattaccacctagtcctaccgagagaaccaacgaccaaagaccacgctagtactctagactaaaagtcgaaacnggtcgtagaacggacgtacccgggaaggaacccgaccggggttcttggttacgttaaacgtttaccgtaggttacgaaacggaaagggtaccgggtcccgggggttacgggacccggggggttaagggtttaccggggggtaggtttcgggacttaaacgtttaaccgttaaaccgttaaccggttacggggttaaacgttacggggtaccgggttacgggtaccgggggtaaccggaaaaccgggggtacccgtaaaccgggtccgtaaccccgttaccgtcccgtaccgacgtcccttaacccgaaccgtaccgggaccctacggttcccgttcccgttcccccgcggtcccgccgtccgccgtaccgacggtaccgccgacccgtccggtacggggaccg

SEQ ID NO: 364785 - DNA, 616 bp, Homo sapiens
  misc_feature: GZ8MTXP02JA5XW.44.38.D05.1.454.CMB.2.raw
  modified_base (385)..(385): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcacgccaccctcagtgtcagtcggcccaggaaagacggccaggattaccgtggtagggggaaacaacagttaggaaagttaaaagtgtgcacgtggtaccagcagaagccaggccacggcccctgtgcgtggtcatctattatgatcgcgacccggcctcgacgggactcccgtaggacgcgtacttctccgtgcctaccaacgttcgtacgggaaccnccgggcccaccctcgaccatcgagacgaggggtacgaacgggcccggggatcgggacggccgacttagttaccgtgtacgagcgttgggtacggacgtagtacggtagtagtactcgtactcccggtggttacgtcggggcggtaacgggacaggtccgtcgaccgttcgtcgggtaccacggacccgaaggtccgtccggtcccccgtcggtccaccgttcgtttccccg

SEQ ID NO: 364786 - DNA, 706 bp, Homo sapiens
  misc_feature: GZ8MTXP02FQKP6.44.38.D05.1.454.CMB.2.raw
  modified_base (199)..(199): a, c, t, g, unknown or other
  modified_base (327)..(327): a, c, t, g, unknown or other
  modified_base (350)..(350): a, c, t, g, unknown or other
  modified_base (399)..(399): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccncaagctccgagggagggctggtgtgggtctcacgttattaatagtgatgggagtagcacaagctacgcggactccgtaggaacggccgattcaaccatcctccagacgacaaacgccaaagaacacgntgtatctagacaaaatcgaaacngtctaggaagacgaccggaggaccgacggcttgtagtaatttacgtgtnacgaagacggcggggtggacggggtagggttcggggagttagacacttactaacgttaacgtacggtagttacgggaacggttcggtacgggggacccgaaacgggggtaccccgtaccgggtacccgacccggtttccgtaccccttacgaccgttaccccttacccgaaccccggaaaccggggtccccctaacgtttcccccggttccccgtttcccccccggcgggtcccccgtcccccgttacgccccgttacccggacgggtaaccgtccccgacccgttccggggtcccgggggaacccg

SEQ ID NO: 364787 - DNA, 585 bp, Homo sapiens
  misc_feature: GZ8MTXP02ISQQQ.44.38.D05.1.454.CMB.2.raw
  modified_base (226)..(226): a, c, t, g, unknown or other
  modified_base (301)..(301): a, c, t, g, unknown or other
  modified_base (304)..(304): a, c, t, g, unknown or other
  modified_base (340)..(340): a, c, t, g, unknown or other
  modified_base (405)..(405): a, c, t, g, unknown or other
  modified_base (420)..(420): a, c, t, g, unknown or other
  modified_base (424)..(424): a, c, t, g, unknown or other
  modified_base (429)..(429): a, c, t, g, unknown or other
  modified_base (435)..(435): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatggggaggcttagttcagcctgggggtccctgagactctcctgtgcagcctctggattcaccttcagtanctactggatgcatggtccgcaagctccgagggaggggctggtgtgggtctcgacgtattatagtgatgggagtancanaagctacggccgactccgtgaaggccaattcaaccntcctccaagacaccaaccgcaaacgaacacgctagtatctagaccaaaatcgaaacagtctaganacgcgaagcacggtntgtntatcngacganaaggcgcgggtggacgggtaggtacgggattcgactacgtacgtacgtacgtacgtgtacggacgtcggacgggaaccaacgggtacccgtaaccggttccacccgttccgtacccgacgtaccgtaccctacccgaacccgacggtccc

SEQ ID NO: 364788 - DNA, 634 bp, Homo sapiens
  misc_feature: GZ8MTXP02I7HXY.44.38.D05.1.454.CMB.2.raw
  modified_base (190)..(190): a, c, t, g, unknown or other
  modified_base (225)..(225): a, c, t, g, unknown or other
  modified_base (236)..(236): a, c, t, g, unknown or other
  modified_base (285)..(285): a, c, t, g, unknown or other
  modified_base (612)..(612): a, c, t, g, unknown or other
tcagacagtatatacacgaccggtgctcgatttagtatctgatagttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcacgtgganccagcgtaatnttcttagtcttaactttgtctcctggtatcaacatcatccaaggtaacncccctaaatcatcatctatgacgtcctaagtaacgacggtcccctacgtaacggggtttctaagtcgtacttccactcgccctaccgaagtcccggacacgaccgccctccgtgacaatctcgtgggcctccgagctggacggtacgacggtctagtattagttatttgttcgtcttacgagtacgttcggttccgcgtctacttctaaactttgttcgttacgttaccggggtaaaggttcggggtaaacctaacggggttaccctaacccggtttaccgttacgggacctaccggaaccccgtaacggttacccaaaaccccgtnttacggtacctacgtttccccg

SEQ ID NO: 364789 - DNA, 542 bp, Homo sapiens
  misc_feature: GZ8MTXP02JR8FF.44.38.D05.1.454.CMB.2.raw
  modified_base (191)..(191): a, c, t, g, unknown or other
  modified_base (209)..(209): a, c, t, g, unknown or other
  modified_base (224)..(224): a, c, t, g, unknown or other
  modified_base (283)..(283): a, c, t, g, unknown or other
  modified_base (370)..(370): a, c, t, g, unknown or other
  modified_base (417)..(417): a, c, t, g, unknown or other
  modified_base (430)..(430): a, c, t, g, unknown or other
  modified_base (449)..(449): a, c, t, g, unknown or other
tcagacagtatatacacgaccggtgctcgatttagtatctgatagttgggtttgggggggtcacaagaggcagcgctctcgggacgtctccaccatggcctgggctctgctgctcctcactctcctcacccaggacacagggtcctgggcccagtctgccctgactcagcctgcctccgtgtctggggtcncctggacagtcgtcaccntctcctgcactgganccagcgtaatattcttagtcttaacttgtctcctgtatcaacatcatccaaggtaaacncccccaaatcatcatcgtatgaggcctaataacgagggtcccctcgtaggggttttctactcgtcttccactgcctacaagtcccgnacacggcctccctgaacatctactggctcaggctgaggacaggcagnttaattatgttanctcagtattcgtcgtaccntactctacttagtcgttcgtaacggaacgtcggaacctaacgtcctaccgtactacggccacgaacccgaacgacccacccatctacctactc

SEQ ID NO: 364790 - DNA, 599 bp, Homo sapiens
  misc_feature: GZ8MTXP02IFK4E.44.38.D05.1.454.CMB.2.raw
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaaggccgatcaccatctccagacacaacgaccaaagaaccacgctagtatcgtagacaaatagaaacagtctgaagacgccgaggacacggcttggtgtattacgtgtcgacaaggacgccggtggcgggtggtcggggagttgacatactacgtacgtacgtagtcggacgtcggtcggggaccgaacgggacccgtaccggtccacccggttcctccgtcacgtaccgttcccaaccgtaaccgggccctacgtcccggttcccttccccgtcggcccgtccctcgcctccgacggtcgaccgacccgtcggcggggacg

SEQ ID NO: 364791 - DNA, 665 bp, Homo sapiens
  misc_feature: GZ8MTXP02H6CYH.44.38.D05.1.454.CMB.2.raw
  modified_base (200)..(200): a, c, t, g, unknown or other
  modified_base (262)..(262): a, c, t, g, unknown or other
  modified_base (299)..(299): a, c, t, g, unknown or other
  modified_base (317)..(317): a, c, t, g, unknown or other
  modified_base (334)..(334): a, c, t, g, unknown or other
  modified_base (349)..(349): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctgggggggtccctgagactctcctgtgcagcctctggattcaccttcagtagctactggatgcactgggtcccncaagctccaggggaaggggctgggtgtgggtctcacgttattaatagtgatgggatagcaanaagctacgcggactccgtggaaggccgatcaccatcnccagagacaacgccaaanaacacgctgtatctganaaaatgaaacagtcngagacgtcgaggacacggtctgtattaattacgtgtcggactaaaggacggtcccgggtaggggtacgggggtaggggttacgggggaaggtttcggactaaacgttaactaaccgtaacggttacggttagtagggtaccggttacggtcgggggacccggaaaggggacccgaccggtaccctaccgtcgtcctacgacgtccgttacccaaccggtaacgggcccctacggtttcccgccctttcccccgcgggtccccgtcccgtacgtcccgaccggacggaccgccgtacccgtcgggtacggggacccg

SEQ ID NO: 364792 - DNA, 642 bp, Homo sapiens
  misc_feature: GZ8MTXP02FNRFO.44.38.D05.1.454.CMB.2.raw
  modified_base (296)..(296): a, c, t, g, unknown or other
  modified_base (377)..(377): a, c, t, g, unknown or other
tcagacagtatatacacgaccggtgctcgatttagtatctgatagctgggttttccttgttgctattttaaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcgactcgtgaaggccatcacatctcaganacaacgccaaagaacacgctgtatctgacaaatgaaactggtctgaacgagccgaaggacacgggctggtagtatttacgnggtagacgtaaaggcggtccggggtggacgggggtaggttcgggggtaagttcggacaacgttaacgtaacgttaacgttaacgggtagtaggggtaccgtcggtacgggggaccgaacggggaccgaacgggtcccaccggttcctcccttacgacggtaccttacccgaaccgtaaacggggccctaacgtcccgggttcccttcccccggtcggcccgccctggcccgtaccgacggacgcctaccgtcgggtcggggaccc

SEQ ID NO: 364793 - DNA, 598 bp, Homo sapiens
  misc_feature: GZ8MTXP02GMEO6.44.38.D05.1.454.CMB.2.raw
  modified_base (270)..(270): a, c, t, g, unknown or other
  modified_base (293)..(293): a, c, t, g, unknown or other
  modified_base (302)..(302): a, c, t, g, unknown or other
  modified_base (345)..(345): a, c, t, g, unknown or other
  modified_base (391)..(391): a, c, t, g, unknown or other
  modified_base (409)..(409): a, c, t, g, unknown or other
  modified_base (560)..(560): a, c, t, g, unknown or other
tcagacagtatatacacgaccggtgctcgatttagtatctgatagttgggtttggggctgggcctaaggaagcagcactggtggtgcctcagccatggcctggacctttctcctcctcggcctcctctctcactgcacaggctctgtgacctcctatgtgctgactcagccaccctcagtgtcagtcggccccaggaaagacggccaggattacctggtagggggaaacaacgattaggaaagtaaaagtgtgcatggtaccagcagaanccaggccaggccctgtgctggtnatctaattntgatacgcgaccggcctcgagggactccgtgacgcgactttcncgtcgcctccaacttcgtcggactactacgaacggtccttacccgnggtacccatttcccgtanacgttccctctaagttcgtagaggacttggacggtctagtaactttaactgtgtgacagcaggtgggatggacgacggaccggacggtgtacggggttcggttacgggcgggtacgggaaacacggttccgaccgttacgtacgggtaacnccgtacggaacgtccgtacccgccccgtacggtacccg

SEQ ID NO: 364794 - DNA, 480 bp, Homo sapiens
  misc_feature: GZ8MTXP02HCIX6.44.38.D05.1.454.CMB.2.raw
  modified_base (370)..(370): a, c, t, g, unknown or other
  modified_base (460)..(480): a, c, t, g, unknown or other
tcagacagtatatacacgaccggtgctcgatttagtatctgatagttgggtttgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggagtcgtggggccaagggaccacggtcaccgtctcctcagccttccaccagggcccatcggtccttcccccgtggccgcccctgcctccgacggacgccacctcgtcgggggccacgngccggcccgtgggctcgcgtggtacgagaccttactctatactagtacgtcgtgaggcgggtcgtggtacgaaacggccgacaagttgannnnnnnnnnnnnnnnnnnnn

SEQ ID NO: 364795 - DNA, 604 bp, Homo sapiens
  misc_feature: GZ8MTXP02FKBDI.44.38.D05.1.454.CMB.2.raw
  modified_base (303)..(303): a, c, t, g, unknown or other
  modified_base (318)..(318): a, c, t, g, unknown or other
  modified_base (341)..(341): a, c, t, g, unknown or other
  modified_base (360)..(360): a, c, t, g, unknown or other
  modified_base (368)..(368): a, c, t, g, unknown or other
  modified_base (375)..(375): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgttattaatagtgagtgggagtagcacaagctacggcggactccgtgaagggccatccacatctccaganacacgccaaagaacncgctgtatctgacaaatcgaacngtcaggagacgcgaggacncggctgtntattacngtcgacgagcgccggtggcggggtaggttcggggagttgacactactacgtaacgtacggtagtgggaccgtggtcggggaccgaagggacccgtacgggtacccaccgttcgtcctcgaccgtccgtccccaaacggaccgggcccacgttcccggtccccttcccccgtcggccccgtcctcggtcctcccggacggacgtcccgtaccggtccggaccggggaccg

SEQ ID NO: 364796 - DNA, 739 bp, Homo sapiens
  misc_feature: GZ8MTXP02HZOBZ.44.38.D05.1.454.CMB.2.raw
  modified_base (247)..(247): a, c, t, g, unknown or other
  modified_base (288)..(288): a, c, t, g, unknown or other
  modified_base (303)..(303): a, c, t, g, unknown or other
tcagacagtatatacacgaccggtgctcgatttagtatctgatagttgggtttgggggaagaggaagactgacggtcctcccaggagttcaggtgctgggcaccttgggcacgggggaggtgtgtcacaagatttgggctctgggcaccgtgggcatggggaggcttagttcagcctggggggtccctgagactctcctgtgcagcctctggattcaccttcagtagctactggatgcactggtccncaagctccgagggagggctggtgtggtctcacgttattaangtgagtggatagcanagctacgcggactccgagaaggccattcgaccatctccagacaaccacgaccaagaaccagcctagtatctagaccaaagttgaaacgtagtacctgaagacggacccggtaagggacccaacggggtctttaggtacgttaaacgttccgttaggtacggaaccgtaaaagggtacggggtcccccggggtttaaggggcccgggggtttaaacggggttcccggggggttaatttacggggacctttaaacgttaaccggtttaaaccgtaacgggttaaaccgggttaagttacccggggacgttttaccggggtacgggggaaacccgttaaaacgggggcccccttaacgggggtaccctaaaccccgggttcttcccccgtacggtaccgtacccctttaccccgaaaccggtaaaaccggggttccccc

SEQ ID NO: 364797 - DNA, 698 bp, Homo sapiens
  misc_feature: GZ8MTXP02GM24T.44.38.D05.1.454.CMB.2.raw
  modified_base (515)..(515): a, c, t, g, unknown or other
tcagacagtatatacacgaccggtgctcgatttagtatctgatagttgggtttggggggaagaggaagactgacggtcctcccaggagttcaggtgctgggcaccttgggcacgggggaggtgtgtcacaagatttgggctctgggcaccgtgggcagtgggggaggcttagttcagccgtgggggtccctgagactctcctgtgcagcctctggattcaccttcagtagctacgtggatgctacgtcgggtcccgacaagcctaccggaggggaaggggtctgggtggtcgggtctacgacgttaattaagtagtagacgtagggagtacgacaacaagcgtaacggcggtaccgtaccggtaggaacgggcctacttaccgaacctacttccaccgaagaacaacccgtaaaccgaccaaaagaaccacgtaccttagtactcacggaaactaaaagtcgaaactagtacgagaaacgacgaccggaagaccgacgtctaggtatacgttagngtagaaccgaaggacgggtccgggtaggaccggggttaggggttcggggaattgactaaactacgttaacgtacgtaaacggtggtacgtacggttcggcgggaaaccgaaacgggtcccaaccgggtctacccggtcctcccgtagacccgttaccgtacccgaaaaccggtaccgttcccg

SEQ ID NO: 364798 - DNA, 578 bp, Homo sapiens
  misc_feature: GZ8MTXP02FW7FR.44.38.D05.1.454.CMB.2.raw
  modified_base (197)..(197): a, c, t, g, unknown or other
  modified_base (238)..(238): a, c, t, g, unknown or other
  modified_base (251)..(251): a, c, t, g, unknown or other
  modified_base (265)..(265): a, c, t, g, unknown or other
  modified_base (311)..(311): a, c, t, g, unknown or other
  modified_base (317)..(317): a, c, t, g, unknown or other
  modified_base (319)..(319): a, c, t, g, unknown or other
  modified_base (322)..(322): a, c, t, g, unknown or other
  modified_base (324)..(324): a, c, t, g, unknown or other
  modified_base (326)..(326): a, c, t, g, unknown or other
tcagacagtatatacacgaccggtgctcgatttagtatctgatagctgggttttccttgttgctattttaaaaggtgtccagtgtgaggtgcagctggtggagtccgggggagcttagttcagccctggggggtccctgagactctcctgtgcagcctctggattcaccttcagtagctatggatgcactgggtccnccaagctccgagggagggctggtgtgggtctcagtattaanagtgatgggatgnacagcacgcggacnccgtgaggcgatcacatctccagagacaagacaacgaacaacgctntatcananaanananagtgtagagagacgacgacgacgcgtgtagtatacgtgtgacgagacgcggtcggcggtagggtagggtaggtgtacgtactactacgtacgtacgtagtaggtacggtacggtacgggacggacggaccgaccgtaccgtaccgtccgtccgtcgtacgtaccgtaccgaccgacgaccgtaccgtaccgtcccgtcccgtccgtccgtcccgtccgtccgtaccgacgacgaccgaccgtcggtacggcg

SEQ ID NO: 364799 - DNA, 678 bp, Homo sapiens
  misc_feature: GZ8MTXP02FL33A.44.38.D05.1.454.CMB.2.raw
  modified_base (172)..(172): a, c, t, g, unknown or other
  modified_base (198)..(198): a, c, t, g, unknown or other
  modified_base (230)..(230): a, c, t, g, unknown or other
  modified_base (289)..(289): a, c, t, g, unknown or other
  modified_base (315)..(315): a, c, t, g, unknown or other
  modified_base (375)..(375): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttnagtagctactggatgcactgggtccnccaagctccgagggaagggctggtgtggtctnacgtattaatagtgagtgggatagcaacaagctacgcgactcgtgaaggcatcacatcncagagacaacgcaaagacacgctganctgacaaaatgaaacaggttcaggagacgaccgaggacacggcttggtagtaatttacgngtgacaaagggacggccgggtgggccggggtagggttcgggggtaggttgacgtaacttaaccgtaacgttaacgttaaccggtaggttacgggaaccggttcgggtacgggggaacccgaaacggggtaaccccggaacggttcccgaaacccgttccgttacccctacgtaaccgtcccgttaacccgaaccgtaaaaccggggacccctaacggttccccggtccctttccccccgcgggtccccgtcccgtcggccctaccgaacgggcaccgtaacccgttcgggacgggggaacccg

SEQ ID NO: 364800 - DNA, 699 bp, Homo sapiens
  misc_feature: GZ8MTXP02HRJDO.44.38.D05.1.454.CMB.2.raw
  modified_base (199)..(199): a, c, t, g, unknown or other
  modified_base (364)..(364): a, c, t, g, unknown or other
  modified_base (403)..(403): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccnccaagctccgagggagggctggtgtggtctcagtattaatgtgagtgggaatagcacgaagctacggcggactccggtaggaacgggccgtattccacctatcctaccgagagaccaaacggccaaaagaaccacgtctagtactctagactaaaagtcgaaacngttacaggaacgacggacccggaaggtacaccggggttnttcggttagttacttacgtgtacgaacggaaggtcgggtcgggtagggtacggggtagggttcggggtagttcgtactacgttaacgtaacgttacgttacggtagtcggtacggtcggtacggggaccgaacgggaccgtaccgtaccgtacccgttcctccgtacgaccgtcccgtacccgaaccggtaaccggtacccgtacggttccccggttcccgttccccggcgtcccgtacccgtcgtaacccgtaccgacggtaccgtacccgtaccggttccgggtacgggtaccg

SEQ ID NO: 364801 - DNA, 636 bp, Homo sapiens
  misc_feature: GZ8MTXP02F0QFP.44.38.D05.1.454.CMB.2.raw
  modified_base (283)..(283): a, c, t, g, unknown or other
  modified_base (297)..(297): a, c, t, g, unknown or other
  modified_base (305)..(305): a, c, t, g, unknown or other
  modified_base (320)..(320): a, c, t, g, unknown or other
  modified_base (345)..(345): a, c, t, g, unknown or other
  modified_base (515)..(515): a, c, t, g, unknown or other
tcagacagtatatacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtcgggtccgccaagctccgaggggagggctggtgtgggtctcacgtattaatgtgagtgggagtagcaacaagctaacggcggactccggngaaggccatcacanctccaganacacgacaagacacnctgatcagacaaaatcgaactcgtntaggagacgccgaaggaccgacggctggtacgttattacgtgtacgacaaagggcggcggggtggacggggtagggttacggggtaggtgactacgtaactacgttaacgtacgtgtacgggacgtacggtacggggaccgaagggacccgacggtacccgaccgttccnccgttacgaccgtacctacccgaaccgaaccggcccgtacgtcccggttccccttccccgccggtccccgcccgttcgcccgtccgacggaccgtcccgtaccgtccggtacggggacccg

SEQ ID NO: 364802 - DNA, 546 bp, Homo sapiens
  misc_feature: GZ8MTXP01DUBFN.13.53.E09.1.454.CMB.2.raw
  modified_base (196)..(196): a, c, t, g, unknown or other
  modified_base (342)..(342): a, c, t, g, unknown or other
  modified_base (368)..(368): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcggcaagtcagacattggcaactcttaaatggtatcagcagaagtcagggcaagccccgaacctcctgatctacggtacatccactttgcacagtggatcccatccaaggttcagtggcaagtagntctgggaaactagtaacttttacccncaacccatcgaggggtctacagcctagaagtattttgctacttactattgtactaaactagtaacgtttaacccttcctcccccggacgttccggacccgaaacgggtaaccgaacggttaggaaagtaacaaagcgaaacttgtaggcttgcaccaatctgtctcatcttccgaacc

SEQ ID NO: 364803 - DNA, 545 bp, Homo sapiens
  misc_feature: GZ8MTXP01B0SK1.13.53.E09.1.454.CMB.2.raw
  modified_base (352)..(352): a, c, t, g, unknown or other
  modified_base (378)..(378): a, c, t, g, unknown or other
  modified_base (425)..(425): a, c, t, g, unknown or other
  modified_base (527)..(527): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactcttaaatggtatcagcagaagtcagggcaacgccccgaacctcctagactctacggtacatccactttgcacgagtggatcccatcccaaggttcagtggacaagtagntcgtaggaaactagtacttttacccncaccatcgagggtctacagcctagaagtatttagcgtacttatattntacgaaactagtaacgttaccttctcccgaacgtacgttaccggcgtaaacgggaccgtaaggacggaaatacagacgacgtagtagcgttgcaacactctntcttactcttcgttcccg

SEQ ID NO: 364804 - DNA, 592 bp, Homo sapiens
  misc_feature: GZ8MTXP01CJC3V.13.53.E09.1.454.CMB.2.raw
  modified_base (344)..(344): a, c, t, g, unknown or other
  modified_base (366)..(366): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaagccccgaactcctgatctacggtacatccactttgcacagtggatcccatccaaggttcagtggcaagtagntctaggaactagtatttacccncacatcagggtctacagctagaagtatttgcgtacttactattagtacaactagtacgttaaccttccgtcccccggacgtttccggaccgtaaacggggacccaaagggttaggaaaacgttaaccgaaaggccggtaaaccttggttaacggggcttacgggcccaaccccgtaagttacccctggttcctttcccgttaattccccttttccccggtaacccg

SEQ ID NO: 364805 - DNA, 541 bp, Homo sapiens
  misc_feature: GZ8MTXP01DGT7R.13.53.E09.1.454.CMB.2.raw
  modified_base (341)..(341): a, c, t, g, unknown or other
  modified_base (368)..(368): a, c, t, g, unknown or other
  modified_base (526)..(526): a, c, t, g, unknown or other
  modified_base (537)..(537): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggatcagcagaagtcaggcaagccccgaactcctgatctacggtacatccactttgcacagtggactcccccatcaaggttcagtggcngtagatctaggaacagtactttacccncacatcgagggtctacgagcctagaagtatttgcgtaactttactaatttgtactaaacagtacgtttacccttccgtcccccgggtaagtttccggaccgaacgggaccaaagggtaaggaaacttcgaaagcgaaacgtgttaggcttggcacctntctcttcttcncttc

SEQ ID NO: 364806 - DNA, 587 bp, Homo sapiens
  misc_feature: GZ8MTXP01CEPOJ.13.53.E09.1.454.CMB.2.raw
  modified_base (345)..(345): a, c, t, g, unknown or other
  modified_base (366)..(366): a, c, t, g, unknown or other
tcagtcacgtactacacgaccggtgctcgatttagagagagtgtgttgggtttggggagtcagtctcagtcaggacacagcatggacatgagggtcccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcccaaggttcagtgcaagtagntctggaacagacttttacccncaccatcaggggtctacagcctgaagtattttgcgtactttactatttgtacaaactagtaacgtttaacccttccgtcccccggtaacgtttccggacccgaacgggtaaccgaaacgggttacgggaaaagttaaccgaaaggacgtaaaccgttggttacgggcttcggcaccctaactcttcggttctttcttaacttccctttccccggtaacccc

SEQ ID NO: 364807 - DNA, 536 bp, Homo sapiens
  misc_feature: GZ8MTXP01CQ3VQ.13.53.E09.1.454.CMB.2.raw
  modified_base (344)..(344): a, c, t, g, unknown or other
  modified_base (366)..(366): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaagccccgaactcctgatctacggtacatccactttgcacagtggatcccatccaaggttcagtggcaagtagntctaggaacagtactttacccncaccatcaggggtctacagcctagaacgtattttgcgtacttactattgtacaactagtacgttaacccttcctcccccggtacgtttcggaccctaaggggacccaaagggtcggaaatcaaagcgaaacttgtaggcttgcaccaatctgtcttcatcgttcccgtcc

SEQ ID NO: 364808 - DNA, 574 bp, Homo sapiens
  misc_feature: GZ8MTXP01C50SU.13.53.E09.1.454.CMB.2.raw
  modified_base (349)..(349): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaagccccgaacctcctgatctacggtacatccactttgcacagtgggactccatccaaggttcagtggcaagtagntctgggaaacagtatttacccncaccatcgaggggtctacagacctagaagtattttgcgtacttactattgtacaaactagtacgtttaccttcccgtcccccggtaacgttccggtacccgaacggggtaaccccaaagggtacggaaacttaacgaaacgcgaaaccgttggtaggcttggcacccgtaattccgtgtaccttcacttccttccccgtaacc

SEQ ID NO: 364809 - DNA, 571 bp, Homo sapiens
  misc_feature: GZ8MTXP01DI8K8.13.53.E09.1.454.CMB.2.raw
  modified_base (372)..(372): a, c, t, g, unknown or other
tcagtcacgtactacacgaccggtgctcgatttagagagagtgtgttgggtttgggggcaggagtcagtctcagtcaggacacaacatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacactccactttgcacagtggatccatcaagttcagtgacagtaagatcgtaggaacagtacttttacccncactatcgagggtctacgagcctagaagtatttgcgtaacttactattggtactaaacgtagtacgtttaacccttcccgtacccccggtacgttccgaccgtaacgggaaccgtaacggtaggtaaactaacgaaaggacgttaaccgtaggtcgacgttcgaccaacactctcgttcttctaacgttccgttccccg

SEQ ID NO: 364810 - DNA, 540 bp, Homo sapiens
  misc_feature: GZ8MTXP01BEFBL.13.53.E09.1.454.CMB.2.raw
  modified_base (347)..(347): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaactcctgactctacggtacatccactttgcacagtggatcccatccaaggttcagtgcaagtagntctaggaacagtacttttacccacaccatcgagggtctacgagtcctagaagtatttcgacgtacttactattcgtactaactaggtaacttaccgttccgtccccggtacgttcggaccgaacggtaaccgaaggtacgaaataacaagcgacttgtagcttgcacaatctcgttctcactccttcccgtcc

SEQ ID NO: 364811 - DNA, 578 bp, Homo sapiens
  misc_feature: GZ8MTXP01DZAZ8.13.53.E09.1.454.CMB.2.raw
  modified_base (358)..(358): a, c, t, g, unknown or other
  modified_base (384)..(384): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggatcagcagaagtcagggcaacgccccgaaactcctgactctaacggtacatcccaactttgcacagtggactccccccatcaaaggttcaagtgacaaggtanatcgtaggaactagtacttttacccncaaccatcgaggggtctaacaggcctagtaagtatttcgactaactttactagttagtacaaactacgtacttacccgttccgtccccggtagtcgtaccggaacggaccgaaggtaacggaaacttacgaacgacgtaaacgtcgttcggcttcggaacacctaacttcgtcttacttcttaacgtttccccg

SEQ ID NO: 364812 - DNA, 599 bp, Homo sapiens
  misc_feature: GZ8MTXP01DLOEH.13.53.E09.1.454.CMB.2.raw
  modified_base (340)..(340): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatcccagatgagccagtctccatccaccctgtctgcgtctctcggagacagggtcaccatcacttgtcgggcaagtcagacatgcatcttaaatgatcagcagaagtcagggcaacgccccgaacctcctgactctacggtacatccactttgcacagtggactccccatcaaggttcagtggcngtagatctggaacagtactttaccctcaccatcgagggtctacagcctagagtatttgcgtaccttatagttctactaaactacgtaacgtttccctccgttcccccgggtaacgtttccgggtacccgtaaacggggtacccgaaaggggtaacggttaaacgttacgtaaaggttaccggaaacgttcggttaggggcccgttacgtaaccgtaccgtaacgttacgttcgttacctttaaccgttaaccgttcccg

SEQ ID NO: 364813 - DNA, 614 bp, Homo sapiens
  misc_feature: GZ8MTXP01AXEJL.13.53.E09.1.454.CMB.2.raw
  modified_base (339)..(339): a, c, t, g, unknown or other
  modified_base (342)..(342): a, c, t, g, unknown or other
  modified_base (348)..(348): a, c, t, g, unknown or other
  modified_base (359)..(359): a, c, t, g, unknown or other
tcagtcacgtactacacgaccggtgctcgatttagagagagtgtgttgggtttggggagtcagtctcagtcaggacacagcatggacatgagggtcccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaatggtatcagcagaagtcagggcaagccccgaactcctgatctacggtacatccactttgcacagtggatccatccaaggttcagtgcaagtantcnggaacngtatttacccncaccattcgaggggtctacacgcctagaagtatttggactacttactatttagtacgtaaactaaggtacgtttaacccgttcccgtacccccgggtacgtttacccggaccggaacgggaaaccccgtaaagggttacgggaaacgttaaccgaaacggaccggtaaaccgttggtaacgggtcgttacggcccgacccgtaaaccgttccttcggttccctttaacgttacccttcgtttcccccggttcccg

SEQ ID NO: 364814 - DNA, 548 bp, Homo sapiens
  misc_feature: GZ8MTXP01D17FC.13.53.E09.1.454.CMB.2.raw
  modified_base (347)..(347): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactcttaaattggtatcagcagaagtcagggcaacgccccgaactcctgatctacggtacatccactttgcacagtggatcccatccaaggttcagtggacaagtagntctaggaactagtacttttacccncaccatcgagggtctacgacgactagaagtatttgactacttactattcgtacaactagtacgttacccttccgtccccggtacgttccggaccgacggtaccgaacggtaggaaataacgaacgacgacgttagtcgcgttcgcactaatactctctcttactccgttccgtaacc

SEQ ID NO: 364815 - DNA, 587 bp, Homo sapiens
  misc_feature: GZ8MTXP01DPFHY.13.53.E09.1.454.CMB.2.raw
  modified_base (368)..(368): a, c, t, g, unknown or other
tcagtcacgtactacacgaccggtgctcgatttagagagagtgtgttgggtttgggggcaggagtcagtctcagtcaggacacaacatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaaactcctgatctacggtacatccactttgcacagtggatccatcaaggttcagtgcagtgatctaggaacagtattttacccncaccatcaggggtctacagacctgaagtatttgacgtactttaactatttggtactaaacgtagtacgtttaacccttccgtcccccggtacgtttccggaccgtaaacggggaaccgtaaacgggtaggtaaaacgttacgaaacggacgaaaccgtacggtgggttcttcggttaccaacctaaatccttcgtcctttctaacgttccgtttccccg

SEQ ID NO: 364816 - DNA, 566 bp, Homo sapiens
  misc_feature: GZ8MTXP01C2QVF.13.53.E09.1.454.CMB.2.raw
  modified_base (345)..(345): a, c, t, g, unknown or other
  modified_base (369)..(369): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaacgccccgaactcctgatctacggtacatccactttgcacagtggatcccatccaaggttcagtgcaagtagntctaggaaacagtacttttacccncaccatcaggggtctacagcctagaagtatttgcgtacttactattgtacaaactagtacgtttacccttcgtcccccggtacgttccggacctaaacgggacccgtaaagggacggaaaagttaaccgaaagcggtaaacgttgttacgggacttcggcacccaattctcgttcttcacttccgttaacccgtccc

SEQ ID NO: 364817 - DNA, 607 bp, Homo sapiens
  misc_feature: GZ8MTXP01DSONH.13.53.E09.1.454.CMB.2.raw
  modified_base (346)..(346): a, c, t, g, unknown or other
  modified_base (368)..(368): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaagccccgaacctcctgatctacggtacatccactttgcacagtggatccatccaaggttcagtggcaagtantctggaaacagtacttttaccncaccatcgaggggtctacagcctagaagtattttgtagtacttacttattcgtactaaacctagtaacgtttaacccctttccgtacccccggtacgtttccgggacccgaaacgggggtaaccctaaaggggtacggtaaaataaccgaaaggttcggaaaccttgggtacgggtcttacgggccttacccctaattcccttggttcctttacttacttcccttttccccggtaaccc

SEQ ID NO: 364818 - DNA, 569 bp, Homo sapiens
  misc_feature: GZ8MTXP01DLOZP.13.53.E09.1.454.CMB.2.raw
  modified_base (348)..(348): a, c, t, g, unknown or other
  modified_base (370)..(370): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgactctacggtacatccactttgcacagtggactcccatccaaggttcagtgacaagtagntctaggaacagtactttacccncaccatcaggggtctacagtcctagtaagtatttgacgtacttactattcgtacaactagtacgtttacccttaccgtcccccggtacgtccggtaccgaacgggtaccgtaaacggtaaggaaacgtaacaacgacgtaacgttaggtacgcgttcgcacctaactctaacgttcttcttacttccttcccgtaaccc

SEQ ID NO: 364819 - DNA, 542 bp, Homo sapiens
  misc_feature: GZ8MTXP01AMZGJ.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacataccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatcccatccaaggttcagtggcaagtagaatctagggaacagtactttaccctcaccatcgaggggtctacgagcctagaagtatttgcgtacttactattgtacaacagtacgttaccttccgtccccgtacgttccgaccgtaacgggtaccgaacggtaggaaataacaacgcgaaacttcgtaggcttcgcaccaatctgtctcttactccttcccgtcc

SEQ ID NO: 364820 - DNA, 571 bp, Homo sapiens
  misc_feature: GZ8MTXP01ERW2Y.13.53.E09.1.454.CMB.2.raw
  modified_base (359)..(359): a, c, t, g, unknown or other
  modified_base (383)..(383): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagagtcgaggcaacgccccgaaacctcctagactctaacggtactatcccactttgcacaggtggactcccccatcaaaggtcagtggacaaggtanatctaggaactagtactttacccncaccatcgaggggtctacgagtcctagaagtatttgacgtaacttactagttacgtacaaactagtacgttaccctccgtaccccggtacgtcgtaccgacggaaccgaagggtaaggaaacgttacgaaacgacgaacgtcgttaggcttcgaacacctaactactcgttcttcgttaacgttcccg

SEQ ID NO: 364821 - DNA, 558 bp, Homo sapiens
  misc_feature: GZ8MTXP01E1H0R.13.53.E09.1.454.CMB.2.raw
  modified_base (345)..(345): a, c, t, g, unknown or other
  modified_base (348)..(348): a, c, t, g, unknown or other
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcagggcaacgccccgaactcctgactctacggtacatccactttgcacagtggactcccatccaaggttcagtgcaagtagntcnggaacagtacttttacccncaccatcagggtctacagcctagtaagtattttggactacttactattcgtacaactaagtacttacccttccgtccccggtacgttcggaccgtaacgggaaccgaacggtaggaaataacgaaacgacggaacttaggttcggcgttcgcacctaatcgttcgttcttcttactccgtttcccgaaccg

SEQ ID NO: 364822 - DNA, 566 bp, Homo sapiens
  misc_feature: GZ8MTXP01ENOEK.13.53.E09.1.454.CMB.2.raw
  modified_base (376)..(376): a, c, t, g, unknown or other
tcagtcacgtactacacgaccggtgctcgatttagagagagtgtgttggggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaacgccccgaactcctgactctaacggtacatccatttgcacagtggactccccatcaagttcagtggcaagtagatcgtaggaactagtacttttacccncacatcgagggtctacagctagaagtatttgacgtacttaactattcgtactaaacacgtacgtttaacccttccgtacccccggtacgttccggtaccgaacgggaaccgaagggtaacggaaattaacgaacgacgaacgtagttcggacgttcgaacaccctaatctcgttcttcttaacgttcccg

SEQ ID NO: 364823 - DNA, 534 bp, Homo sapiens
  misc_feature: GZ8MTXP01BP66C.13.53.E09.1.454.CMB.2.raw
  modified_base (509)..(509): a, c, t, g, unknown or other
  modified_base (516)..(516): a, c, t, g, unknown or other
  modified_base (521)..(521): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggatcagcagaagtcagggcaacgccccgaactcctgatctacggtacatcccactttgcacagtggactcccccatcgaagtcagtcgcaagtagatcgtaggaactagtacttttacccacacctatcgaggggttactacgagcctagaagtatttcgacgtactttactagttacgtcaacacgtacgttacccttccgtacccgtacgtcgacgacggacaggtaaggaattgaacgcgtactgcggttcncgcaccntcgtnttctcttaatccc

SEQ ID NO: 364824 - DNA, 559 bp, Homo sapiens
  misc_feature: GZ8MTXP01B0N8S.13.53.E09.1.454.CMB.2.raw
  modified_base (403)..(403): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaacgccccgaactcctgatctacggtacatccactttgcacagtggactcccccatcaaggttcagtgcaagtagatcgaggaactagtactttaccctacacatcgagggtctacgagctagaacgtntttgacgtacttacttattgtacaaactacgtacttacccttccgtaccccggtacgttccggtaccgaacgggtaccgaaggtaaggaaacgttacgaaacgacgtaacgtcgttaggcgttcgcacaacttctcgttcttcgttaactttcccg

SEQ ID NO: 364825 - DNA, 554 bp, Homo sapiens
  misc_feature: GZ8MTXP01CYHIU.13.53.E09.1.454.CMB.2.raw
  modified_base (228)..(228): a, c, t, g, unknown or other
  modified_base (377)..(377): a, c, t, g, unknown or other
  modified_base (535)..(535): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcanaacgattggacaactctttaaattggtatcagcagaagtcaggcaacgccccgaacctctgactctaacggtacatccactttgcacagtggactcccatcctaaaggttcagtggcaaagtagaatcgtaggaactagtactttaccncaccatcgaggggtctacgacgtcctagtaacgttatttcggactacttactattcgtacaactacgtacttacccttaccgccccggacgttccggaccgaagggacccaaggtagaaatcgaaagcgaaacgttgtacggcttacgcaccaatctnttctcacttccgttccgtc

SEQ ID NO: 364826 - DNA, 564 bp, Homo sapiens
  misc_feature: GZ8MTXP01D8DNE.13.53.E09.1.454.CMB.2.raw
  modified_base (344)..(344): a, c, t, g, unknown or other
  modified_base (372)..(372): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatcccatttgcacagtggactcccccatcaaggttcagtggcngtagatctaggaaacagtattttacccncaccatcgaggggtctacgagcctagaagtatttcgcgtaacttactattgtacaaactagtacgttacccttccgtaccccggtacgttccggaccgtaacgggtaaccgaaagggtaaggaaacttacgaaacgacgaaacgtggttacggcgttcgaaccactaactctgttcttcgttaacgttcccg

SEQ ID NO: 364827 - DNA, 542 bp, Homo sapiens
  misc_feature: GZ8MTXP01AYAH4.13.53.E09.1.454.CMB.2.raw
  modified_base (287)..(287): a, c, t, g, unknown or other
  modified_base (345)..(345): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaacgccccgaactccngatctacgtacactccactttgcacagtggatcccatccaaggttcagtgcaagtagntctaggaactagtactttacccacacctatcgaggggtctacgacgcctagaagtatttcgacgtacttaactattgtactaactagtacgttaccgttcctccccggacgtcggtaccgaacggtaccgaaggtacggaaataacgaacgacgaacttgtggcttgcaccgaatctcgtcttcactcttcccgtcc

SEQ ID NO: 364828 - DNA, 549 bp, Homo sapiens
  misc_feature: GZ8MTXP01EOWYS.13.53.E09.1.454.CMB.2.raw
  modified_base (363)..(363): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcagtcagacattggcaactcttaaatggtatcagcagaagtcagggcaagccccgaactcctgatctacggtcatccactttgcacagtggatcccatccaaggttcagtgcaagtagaatctaggaactagatttttacccncacccatcaggggtctacagcctagaactatttgcgtacttactattgtacaactagtacgttaccttcctccccggtacgttcgtaccgaacggaaccggtaacgtagggtaaagaactaacgttacgaaaccgttgttggcgttcgcgacctaactctcgtcttcttcttcgttcccgtaaccc

SEQ ID NO: 364829 - DNA, 561 bp, Homo sapiens
  misc_feature: GZ8MTXP01A5KA1.13.53.E09.1.454.CMB.2.raw
  modified_base (350)..(350): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaatggtatcagcagaagtcagggcaacgccccgaactcctgactctacggtacatcctactttgcacagtcggactcccatccaaggttcagtggcaagtagntcgtaggaacagtacttttacccacaccatcgagggtctacagctagaatatttgacgtattactattgtacaactagtacttacccgttccgtacccccggtacgttcgacccgaacggtaacccgtaaggtacggtaaagtaacaacggacgtaacgttgtacggcttacggcacctaatctcgttctacttactccgttcccgtaacc

SEQ ID NO: 364830 - DNA, 527 bp, Homo sapiens
  misc_feature: GZ8MTXP01AVOLV.13.53.E09.1.454.CMB.2.raw
  modified_base (342)..(342): a, c, t, g, unknown or other
  modified_base (368)..(368): a, c, t, g, unknown or other
  modified_base (395)..(395): a, c, t, g, unknown or other
  modified_base (511)..(511): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggatcagcagaagtcagggcaagccccgaaactcctgatctacggtacatccactttgcacagtgggatcccccatcaaggttcagtgcngtagatctggaacagacttttacccncaccatcaggggtctacagcctagaanatttgcgtacttactattgtcaacagtacgttacctcgtccccggaacgttcggccgtaacgggacaacgggtaagaaattcgaaacgcgaaactgttagggcttggcacaatctnttcttcttaacgtccc

SEQ ID NO: 364831 - DNA, 577 bp, Homo sapiens
  misc_feature: GZ8MTXP01DUCSW.13.53.E09.1.454.CMB.2.raw
  modified_base (386)..(386): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagaacattggactaacttctttaaaattggtatcagcaagaagtcagggcaacgccccgaactcctgactctacgtacatcccaatttgcacagtggactcccccatacaaggttcagtggcaagtagatctaggaaactagtacttttacccncaccatcgagggtctacagctagaagtatttgctaacttactattgtacaaactagtacgttaacccttccgtacccccggtaagtttccggaaccgaaacgggtaacccgaaagggttaaggaaacttacgaaacgacgtaaacgtggttagcttggccaaccaattcctgttctttcgaactttccccg

SEQ ID NO: 364832 - DNA, 560 bp, Homo sapiens
  misc_feature: GZ8MTXP01CQYX6.13.53.E09.1.454.CMB.2.raw
  modified_base (346)..(346): a, c, t, g, unknown or other
  modified_base (371)..(371): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaacgccccgaacctcctgatctacggtacatccactttgcacagtggatcccatccaaggttcagtggcaagtagntctagggaaactagacttttacccncacccatcgaggggtctacagcctagaagtatttggactacttactattagtacaaactagtaacgtttacccttccgtcccccggtacgttcggtacccgaaacggggacccaaagggtacgaaagtccaaagcgaaacttgtagggcttcggcacccaatcctgttcttcttactcctttcccgccc

SEQ ID NO: 364833 - DNA, 531 bp, Homo sapiens
  misc_feature: GZ8MTXP01ASYR7.13.53.E09.1.454.CMB.2.raw
  modified_base (344)..(344): a, c, t, g, unknown or other
  modified_base (506)..(506): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggacatccactttgcacagtggactccactccaaggtacagtggcaagtagntctaggaacacgtactttaccctcaccatcaggggtctacagcctagaagtatttgcgtacttacttattgtacaactagtacgttacccttccgtccccggacgttcggaccgaacgggtaccgaacggtaggaactaacgaagacggaattcgtagtcgngcacaatctctctcactcttcccgc

SEQ ID NO: 364834 - DNA, 558 bp, Homo sapiens
  misc_feature: GZ8MTXP01DH3NH.13.53.E09.1.454.CMB.2.raw
  modified_base (346)..(346): a, c, t, g, unknown or other
  modified_base (354)..(354): a, c, t, g, unknown or other
  modified_base (372)..(372): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggcaactcttaaattggatcagcagaagtcagggcaagccccgaaacctcctagatctacggtacatccaactttgcacagtggatcccccatcaaggtcagtgcngtagatcnggaacagtactttacccncaacatcgagggtctacgagtcctagaacgtatttgacgtacttaacttattcgtactaaactagtacgttaacccttcctaccccgggacgttcggtaccgaacgggaaccgaaggtaaggaaagttcgaaacgttacgaaacgtgttggcttgccactaactactcgttcttcttaacgttccc

SEQ ID NO: 364835 - DNA, 536 bp, Homo sapiens
  misc_feature: GZ8MTXP01ESKYK.13.53.E09.1.454.CMB.2.raw
  modified_base (351)..(351): a, c, t, g, unknown or other
  modified_base (495)..(495): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggcaagtcagaacattggcaactctttaaattggtatcagcagagtcagggcaacgccccgaactcctgatctacgtacatcctactttgcacagtggacgtccactaccgaggttacgagtggacaagtagntctaggaacagtactttacctacacatcaggggtacacagcctagaatagtttcgacgtacttactattgtacaactagtacgttacctaccgtccccgtagtcgtacgaacggacgaacggtagtaagaactacgagacttgngtcgttcgcacaatctcgttctcttactccgttccgtaacc

SEQ ID NO: 364836 - DNA, 585 bp, Homo sapiens
  misc_feature: GZ8MTXP01EGVN7.13.53.E09.1.454.CMB.2.raw
  modified_base (392)..(392): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaacgccccgaacctcctgatctacgtacatcccaactttgcacagtggatcccccatcaagtcagtggcaagtagatcgtaggaacagtacttttacccacaccatcgagggtctaanacgcctgaagtatttgacgtacttactattagtacaaacagtaacgttaacccttccgtcccccggtacgttccggaccgtaacggaaccggtaaacggtaaggttaaacgacgtaaacgacggtaaacgtaggttacggttcgttcggtcaaccgtaacgtactcggttacttaaccgttaacgtttccccg

SEQ ID NO: 364837 - DNA, 549 bp, Homo sapiens
  misc_feature: GZ8MTXP01DMP4Q.13.53.E09.1.454.CMB.2.raw
  modified_base (341)..(341): a, c, t, g, unknown or other
  modified_base (345)..(345): a, c, t, g, unknown or other
  modified_base (367)..(367): a, c, t, g, unknown or other
  modified_base (395)..(395): a, c, t, g, unknown or other
tcagtcacgtactacacgaccggtgctcgatttagagagagtgtgttgggtttgggggcaggagtcagtctcagtcaggacacagcatggacatgagggtcccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggatcagcagaagtcagggcaagccccgaactcctgatctacggtacatccactttgcacagtggactcccccatcaaggttcagtgcngtanatctggaacagtactttacccncacatcgagggtctacagcctagaagtntttgcgtaactttactattcgtactaaactagtacgtttacccttcgttcccccgggtaacgtttcggaccgaaaggggacccaaagggtaacggaaattccgaaaggcgaaacgtgttaggcttaggcaccaatctcgttcttcgaatttccc

SEQ ID NO: 364838 - DNA, 563 bp, Homo sapiens
  misc_feature: GZ8MTXP01AQQ55.13.53.E09.1.454.CMB.2.raw
  modified_base (347)..(347): a, c, t, g, unknown or other
  modified_base (366)..(366): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactccctgatctacggtacatcccactttgcacagtgggatcccatccaaggttcagtggcaagtagntctgggaacagtattttanccttacacctatcgaggggtctacgagtcctagaagtattttgcgtactttactattgggtacaaacgtagtacgtttaacccttccgtacccccgggacgtttaccggaccgtaacggggaccgaaagggtagggaaaatcaaacggcgaaacgtaggtggcttggcaaccatctgtcttcaacttccttaacccg

SEQ ID NO: 364839 - DNA, 555 bp, Homo sapiens
  misc_feature: GZ8MTXP01CQ4BG.13.53.E09.1.454.CMB.2.raw
  modified_base (348)..(348): a, c, t, g, unknown or other
  modified_base (352)..(352): a, c, t, g, unknown or other
  modified_base (375)..(375): a, c, t, g, unknown or other
  modified_base (532)..(532): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggctaactctttaaattggtatcagcagaagtcaggcaacgccccgaactcctgactctacggtacactcctactttgcacagtggactcccccatcaagttcagtgcngtanatctaggaacagtactttacccncacatcgagggtctacgagtcctagaagtatttgacgtactttactattgtacaacacgtacgttaccctccgtaccccggtacgttccggaccgaacgggtaccgaagggtaagaaacttacgaaacgcgtaaacgtgttacggcttgaacacctntactcgttcttcttaacgttccc

SEQ ID NO: 364840 - DNA, 584 bp, Homo sapiens
  misc_feature: GZ8MTXP01AKTPF.13.53.E09.1.454.CMB.2.raw
  modified_base (375)..(375): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaaacctcctgactctacggtacatccactttgcacagtgggactcccccatcaaggttcagtgcaagtagatctgggaacagtactttacccncaccatcaggggtctacagctagaatatttcgacgtactttactagttcgtactaaacgacgtacgtttaacccgttccgtaccccccggtacggttccggtacccgtaaacgggaacccgtaagggtaagggtaaacttacgaacgaccgtaaacgtcgttacggcgttacgccactaactcgttcgttcttccgttaactttccccg

SEQ ID NO: 364841 - DNA, 564 bp, Homo sapiens
  misc_feature: GZ8MTXP01CGAKA.13.53.E09.1.454.CMB.2.raw
  modified_base (346)..(346): a, c, t, g, unknown or other
  modified_base (367)..(367): a, c, t, g, unknown or other
  modified_base (501)..(501): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtggatcccatccaaggttcagtggcaagtagntctggaacagatttacccctnacccatcaggggtctacgagcctgaagtattttgacgtacttactatttgtacaactagtacgttacccttccttcccccggacgttccggacccgaacgggtaaccgaaacggttaggaaacgtaacaaacgngaaccgttagttgggcttacggcaacctaactcgtcgttcttcttattccgttccccgttccc

SEQ ID NO: 364842 - DNA, 556 bp, Homo sapiens
  misc_feature: GZ8MTXP01ERC2J.13.53.E09.1.454.CMB.2.raw
  modified_base (354)..(354): a, c, t, g, unknown or other
  modified_base (377)..(377): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaacctcctgactcgtacggtacactcctactttgcacagtgggactcccatccgaaggttcagtgcaagtagntcgtaggaacagtacttttaccncaccatcgagggtcacgagctagaacgttatttgcgtacttactattcgtacaactagtacgttacccttccgtccccggtacgttccggaccgaacgggtaccgtaaggtacggaataactaacgacgtacgttggtgtcgttcgcacctaagtctgtcttcacttccttccgtaacc

SEQ ID NO: 364843 - DNA, 625 bp, Homo sapiens
  misc_feature: GZ8MTXP01CW1N3.13.53.E09.1.454.CMB.2.raw
  modified_base (354)..(354): a, c, t, g, unknown or other
  modified_base (379)..(379): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggacaactcttaaattggtatcagcagaagtcagggcaacgccccgaacctcctgatctacggtacatccactttgcacgagtggactcccatcccgaaggttcaggtggacaagtagtntcgtaggaaactagtactttacccncaacctatacgacggggtctacgacgtaccgtagtaaaggttatttacgacgttaactttacctatttacgtacaaactacgtacgtttacccgttccgtacccccggtacgtttccggaccgtaaacgggaacccgtaaaggttacgggaaaattaacgaaacgcggtaaacgttcgttaacggggcttacggcaaccctaattccgtggttacccttcttacctttcccttccccggttaaccc

SEQ ID NO: 364844 - DNA, 599 bp, Homo sapiens
  misc_feature: GZ8MTXP01DXIT6.13.53.E09.1.454.CMB.2.raw
  modified_base (367)..(367): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaatcttaaatggtatcagcagaagtcagggcaagccccgaactcctgatctacggtacatccatttgcacagtggatcccatccaaggttcagtggcaagtagaatctggaaactagtacttttacccnacccatcgaggggtctacagcctagaatattttgcgtaacttactaattgtacaaactagtaacgtttacccttccgtacccccggtacgtttcggaacccgaacggggtaaccgaaacggtaacgggaaagtaaaccgtaaggaaccggaaaccgttaaggtcggtacgttcggcttaaccccgtaattaccttcgtttccttccgttacttcccgtttccccgttaaccc

SEQ ID NO: 364845 - DNA, 638 bp, Homo sapiens
  misc_feature: GZ8MTXP01C4Q3S.13.53.E09.1.454.CMB.2.raw
tcagtcacgtactacacgaccggtgctcgatttagagagagtgtgttgggtttgggggcaggagtcagtctcagtcaggacacagcatggacatgacgggtccccgctcagctccgtggggctcctgctactctggctccgaggtgccagatgtgacatccagatgagccagtctccatccaccctgtctgcgtctcgtcggagacgagggtccaccatcacgttggcgggacaagtcaagaactagttggactaacttactttaaattggatcagcaagaagtcgaggcaacgccccgaactcctgatctacgtacatcctacttgctacaggtggactcccccatacaaggttcaagtggacaagtagatcgtaggaactacgtacttttacccacacctagtacgagggtctaacgacgtccgtagtaacgttatttacgacgttaacttacttagttacgtaactaacgtacgtacgtttacccgttcccgtaccccggtacgttccggacccgtaaacgggtacccgtaaagggtaacggtaaaacgttacggtaaacgacggtaaaccgtggttacggccgttacgaacctacctaacgttacttcgttaccttccgttaaccgtttccccg

SEQ ID NO: 364846 - DNA, 583 bp, Homo sapiens
  misc_feature: GZ8MTXP01D94X3.13.53.E09.1.454.CMB.2.raw
  modified_base (347)..(347): a, c, t, g, unknown or other
  modified_base (373)..(373): a, c, t, g, unknown or other
  modified_base (544)..(544): a, c, t, g, unknown or other
  modified_base (554)..(554): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatgtatcagcagagtcagggcaacgccccgaactcctgatctacggtacatcctactttgcacagtggactcccatccgaaggttcagtggcaagtacgntctagggaaactagtacttttacccnctaacctatcgtaggggtactacgacgacccgttagtaagtagttttacgacgttacttaacttatttacgtactaaactacgtaacgtttacccttccgtacccccggtacgttcggtaccgaacggtaccgaacggtacgaaagtaacaagacgtacgttagtcgtacncggttcactntactctcttcttactccgttcccgtaacc

SEQ ID NO: 364847 - DNA, 567 bp, Homo sapiens
  misc_feature: GZ8MTXP01DNLDX.13.53.E09.1.454.CMB.2.raw
  modified_base (352)..(352): a, c, t, g, unknown or other
  modified_base (541)..(541): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaacctcctgatctacggtacatccactttgcacgagtgggactcccatccaaaggttcagtggacaagtagntcgtggaaactagtactttaccctcaccatcgagggtctacagtcctagagtattttgcgtaacttactattgtactaaactagtaacgtttacccttcgtcccccggtacgtttccggacccgtaacgggacccgtaaagggtacggaaagttaacgaaagcggaaaccttgtacggcgttagcaccntactgtcttcacttccttcccgtccc

SEQ ID NO: 364848 - DNA, 554 bp, Homo sapiens
  misc_feature: GZ8MTXP01CXUWP.13.53.E09.1.454.CMB.2.raw
  modified_base (345)..(345): a, c, t, g, unknown or other
  modified_base (370)..(370): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggacaactctttaaattggtatcagcagaagtcagggcaacgccccgaacctcctgatctacggtacatccactttgcacagtggatcccatccaaggttcagtgcaagtantctagggaaactagtactttacccncaccatcgaggggtctacgagcctagtaagtattttgacgtactttactatttgtacaaactagtaacgtttacccttccgtacccccggtacgtttccggaccctaaaggggacccaaaggtcggaaataacaagcgaaacttggtacgcttgcaccaatctgtcttcattccttccgtaacc

SEQ ID NO: 364849 - DNA, 645 bp, Homo sapiens
  misc_feature: GZ8MTXP01CCRAV.13.53.E09.1.454.CMB.2.raw
  modified_base (350)..(350): a, c, t, g, unknown or other
  modified_base (372)..(372): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttgtcgggcaagtcagaacattggacaactctttaaattggtatcagcagaagtcagggcaacgccccgaactcctgactctacggtacatccactttgcacagtggactcccatccgaggttcagtggacaagtagntctaggaacagtactttacccnacctatcgagggtctacagcctagaaagtattttaggctaactttactatttagtactaaacgtagtaaccgtttacccttccgtacccccgggtacgtttccggacccgtaaagggggaacccctaaagggggtcggtaaaacttaaccggaaaggttccggtaaaaccgttgggttaacgggccgtttacgggcccttaaacccccggtaattccctttaacgggtttccctttaccgttaacctttcccgttttaacccccggtaacccc

SEQ ID NO: 364850 - DNA, 520 bp, Homo sapiens
  misc_feature: GZ8MTXP01DP1YT.13.53.E09.1.454.CMB.2.raw
  modified_base (342)..(342): a, c, t, g, unknown or other
  modified_base (363)..(363): a, c, t, g, unknown or other
  modified_base (502)..(502): a, c, t, g, unknown or other
  modified_base (506)..(506): a, c, t, g, unknown or other
  modified_base (520)..(520): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactcttaaattggtatcagcagaagtcagggcaagccccgaactcctgatctacggtacatccactttgcacagtggatccatccaaggttcagtgcaagtagntctggaaacagattttacccnacccattcgaggggtctacagacctagaagtattttgcgtaacctttataattcgtactaaacagtaacgttaccttctcccccggatttcggaccagggtaccaaggtggaaatcaagcaacgttgtggcttagcacntctntctcttctcttctn

SEQ ID NO: 364851 - DNA, 546 bp, Homo sapiens
  misc_feature: GZ8MTXP01DM3BW.13.53.E09.1.454.CMB.2.raw
  modified_base (348)..(348): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagcccccgaacctcctgatctacggtacatccactttgcacagtggatcccatccaaggttcagtggcaagtagntctaggaacagtacttttacccncaccatcaggggtctacagcctagaagtattttcgcgtacttactattgtacaactagtacgtttacccttcctcccccggacgttccgaccgaacggaaccgaacgtacggaaataacgaagacgaacgttgtaggcttcgcacctaatctcgtcttcttactcttcccgtccc

SEQ ID NO: 364852 - DNA, 916 bp, Homo sapiens
  misc_feature: GZ8MTXP01EG5M9.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcaccatcacttggtcgggacaagtcaagaacattggacaacttctttaaattggtatcagcagagtcagggcaacgccccgaactctgactcgtacggtacatcctactttcgactaacgaggttacgggactaccccgaattacccgaaagggttttcgaagggttacgggaccgtaaaagggttaacggtaacgttacgttaaacgggggtaaaaccttaacgggtttaacctttttttaacccccgacctaaaccctacgttaccggtaacggggggtttacctaaaccgtaacggtacccgtttaaacggtaaaaggtttaacgttttttacggggaacccgtttaaaccgttttaaccgtttaaattttaccgggttaaaccgttaaaaaccgtttaaaccggggtttaaacccggttttttaaaaccccccgttttccccgggttaacccccccccgggggttaaaccgggtttttaccccgggggtaaaccccggggtaaaacccgggggtaaaacccggggtaaaacccgggggttaaaaggggttaaaacgggttaaaaccggtaaacggaaaccgggttaaaccggttaaagggtcggggtttaacggttacccgggttaccgaaacccgttaaccgtttaaccgtttaaccgttttcccgttacctttaaccgtttccccgtttttcccccgtaaccccg

SEQ ID NO: 364853 - DNA, 581 bp, Homo sapiens
  misc_feature: GZ8MTXP01D7ZS8.13.53.E09.1.454.CMB.2.raw
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcaccatcacttgtcgggcaagtcaagaacattggactaactactttaaatggtaatcagcagaagtcagggcaacgccccgaacctcctagactcgtacggtacactcctactttcgcacgaggtcggactcccataccgaaggttcaggtggacaagtagngtcgtaggaaactacgtacttttaccccacaccatcgagggtactacgagcctagaacgttatttcgacgtacttactattcgaccaactagtacgtttaccctccgtccccggtacgttcgaccgaacggtaccgaaggtagaaacgtaacaacggacgaacttcggtgtcgcgcacctaatcttaacgttctcttacttccttcccgtaacc

SEQ ID NO: 364854 - DNA, 571 bp, Homo sapiens
  misc_feature: GZ8MTXP01DS9K9.13.53.E09.1.454.CMB.2.raw
  modified_base (344)..(344): a, c, t, g, unknown or other
  modified_base (366)..(366): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaacctcctgatctacggtacatccatttgcacagtggatcccatcccaaggttcagtgcaagtagntctggaaacagactttaccctnacccatcaggggtctacgagccctagaaagtattttggactacttaactagttgtacgaaactagtagttaacccttccgtcccccggacgtttccggaccgaacgggtaacccgaaacggtacggaaaagtccaaaggacgaaaccgttgttagggccttaggcaaccctaatcctgttccttacttactccgttcccgtcccg

SEQ ID NO: 364855 - DNA, 629 bp, Homo sapiens
  misc_feature: GZ8MTXP01BBEAV.13.53.E09.1.454.CMB.2.raw
  modified_base (585)..(585): a, c, t, g, unknown or other
  modified_base (595)..(595): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaacttctttaaattggtatcagcagagtcagggcaacgccccgaactctgactctacgtacatcctatttgcacgagtcggactcccatccgaaggttcaggtggactaaagtaggtaatcgtagggaaactaggttaaccttttaccccgactaacccagttaccgtaaggggttctaacgacgtacccgttaaggtaagttagttttacgacgttaacttaacttattacgtactaacgtacggttaacgtttaccccgtttacccgtcccccggtacgttccggtaacccggaacggtaaccgaaggttacgaaagtaacgaagacgtaacgttggtgtacgngttcgacctnttacgtgttccttcttacttccttaacccgtccc

SEQ ID NO: 364856 - DNA, 553 bp, Homo sapiens
  misc_feature: GZ8MTXP01BP5IX.13.53.E09.1.454.CMB.2.raw
  modified_base (347)..(347): a, c, t, g, unknown or other
  modified_base (370)..(370): a, c, t, g, unknown or other
  modified_base (534)..(534): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaacctcctgatctacggtacatccactttgcacagtggatccatccaaggttcagtgcaagtagntctgggaacagtacttttacccnctaaccatcgaggggtctacagcctagaagtattttgcgtactttactatttgtacaaacgtacgtacgtttaaccccttccgtccccccggaacgttccggacccgaacgggtaaccgaacggtaggaataacgaagcgaaacttgtagcgttgcacaatctntctcactcttcccgtaacc

SEQ ID NO: 364857 - DNA, 774 bp, Homo sapiens
  misc_feature: GZ8MTXP01C17XO.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttggtcggcaagtcaagaacagttggactaacgttactttaaattggtatcagacaagaagtcgaggggacaaccggccccaacctcctgtactccgtaacggtacaactaccctactttgaccaactaggtgggacctccgataccgtaaggttcagtcgggactaaagtaagtctacgttacgggaaactacggttaactttttaccccactaaccctagttaccggaacggggttccttaacgacgttacccgtaaggtaaacgtttacgttttacgaccggttaactttaacttacgtttacggttaactaaaccgttaacggggttaaacctttaaccccgttttaccccggtaccccccggttaaccggtttaccgggaaccccggttaaacggggtaaaccccgtaaagggggtaacggtaaaacgttaaccggaaaacggttacccgggttaaacgttacgggtttacgggcgtttaccggaccgttaacccgtaagttaccttccggtttacctttacgttaacccttttcccgttaacccccggttaacccg

SEQ ID NO: 364858 - DNA, 724 bp, Homo sapiens
  misc_feature: GZ8MTXP01DUYMC.13.53.E09.1.454.CMB.2.raw
  modified_base (230)..(230): a, c, t, g, unknown or other
  modified_base (254)..(254): a, c, t, g, unknown or other
  modified_base (256)..(256): a, c, t, g, unknown or other
  modified_base (637)..(637): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcaganatgtcgactacttaattagtagtnanagacagtagacggacgacgacccgaccctacctcgatactacgtaacgactacctacttacgttcgacacgtaggtacgtacctactaccgtaacggttacgtacgtaggtacgaacgtaagtaagtactacggtaaacgtaacgtacgtttaccctttaccctacctaacttcgtaacggggggttcctaaccttaacggacccgttaacgttaaaggtaaactttttcgtacccggaaacgtttacctttaatttacgggttacaaaacccgtaaggttacccggttttaaaccccgtttccccgtcccccccgggtaacccggtttacgggtaaaccccgaaacgggggaaccccgtaaaagggtaccgggttaaaanaaacgtacggaacggtaacgttggtacggtcgttacgccaaccctaattacgttcgtttactttaccttcccgttccccgccgtaag

SEQ ID NO: 364859 - DNA, 670 bp, Homo sapiens
  misc_feature: GZ8MTXP01EIHRP.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcaccatcacttgtcgggcaagtcagaacattggactaacttctttaaattggatcagcaagaagtcagggacaacgccccgaacctcctgactctacggtacactccctactttgacacgaggtcggactcccccatacgaaggttccaggttaggactaaggtagacttacgtacgggaaactagtaactttttaccccactacctagtcgacgggttctacgacgtacctagtaagtatttacgactaactttacttacgttacgttaactaaactacgttaaccgttacccttacccgttccccgggtaacggttccggaacccggtaaacgggtaacccgtaagggtaaacggtaaacgttacgtaaaccggttacgtaaacgttacggttacgggccgttacggaacccgtacctaacggttccttcggttacctttccgttaacgttttcccccg

SEQ ID NO: 364860 - DNA, 721 bp, Homo sapiens
  misc_feature: GZ8MTXP01CC4IS.13.53.E09.1.454.CMB.2.raw
tcagtcacgtactacacgaccggtgctcgatttagagagagtgtgttgggtttggggcaggagtcagtctcagtcaggacacagcatggacatggagggtcccgctcagctcctggggctcctgctactctggctccgaggtgccagatgtgacatccagatgagccagtctccatccaccctgtctgcgtctcgtcggagacagggtcaccatcacgttgtcgggcaagtcagaacagttggactaacttctttaaatggtatcagcaagagtcagggacaacgccccgaactctagactcgtacggtacacgtcctactttgacacgaggtcggactcccccaagtacgtaaaggtttccaggttacggactaaggtagtacgtacgtacgggaaactacgttacttttaccccacaaccctaagtcgacggggttacctaacgacgtacctagtaagttacgtttacgacgttaactttaaccgttagtttacggttaacctaaacgtaacgttaaccgtttaaccccgttacccgttacccccgggtaacggttacccggtaacccggtaaacggggtaaacccggaaacggggtaacggtaaaacgttaccgtaaacggttaccggtaaacggttcggttacgggttcgttacggtaaccgtaaccgttaacttaccgttcggtttaccgtttaacccgttaacgttttaaccccg

SEQ ID NO: 364861 - DNA, 591 bp, Homo sapiens
  misc_feature: GZ8MTXP01B70SN.13.53.E09.1.454.CMB.2.raw
  modified_base (352)..(352): a, c, t, g, unknown or other
  modified_base (378)..(378): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggctaactctttaaatggtatcagcagaagtcagggcaagccccgaactctgatctacggtacatccactttgcacagtggactcccccatcaaggttcaggtggcaaggtanatcgtaggaactagtacttttacccnaccatcgagggtctacgacgtcctagtaagtatttagacgtaactttaaattagtttacgtaacaaactacgtaacgttaacccttccgtacccccggtacgttccggtaccgaacggaaccgaagggtaacggaaaacttcgaaacgacgtaaactggttacggcttacggaacctactaacttctcgttacttaaccgttaagtttccccg

SEQ ID NO: 364862 - DNA, 533 bp, Homo sapiens
  misc_feature: GZ8MTXP01COHUT.13.53.E09.1.454.CMB.2.raw
  modified_base (345)..(345): a, c, t, g, unknown or other
  modified_base (368)..(368): a, c, t, g, unknown or other
  modified_base (497)..(497): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaactcctgatctacggtacatccactttgcacagtggactccatccaaggttcagtggcaagtagntctagggaacagtactttacccncaccatcgaggggtctacgagcctagaacgtattttgcgtacttactattgtacaactagtacttaacccttcctacccccgggacgtttccggaccaaacgggaccaaggtcggaaatcaagcgaacngtagcttgcaccgaatctgtcttcatccttcccgcc

SEQ ID NO: 364863 - DNA, 714 bp, Homo sapiens
  misc_feature: GZ8MTXP01EGX2Z.13.53.E09.1.454.CMB.2.raw
  modified_base (226)..(226): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacgagggtccaccatcacttggtcggnaagtcagaacattggacaactctttaaatggtatcagcagagtcgagggcaacgccccgaacctcctgactcgtacgtacactcctactttgcacgaggtcggactcccataccgaaggttcaggtgactaaagtagtaatcgtagggaaactacgtaacctttttaccccactaaccctagttacgaacggggttacctaacgacgtacccgttaaggaaacgttttaactttacggtaccgttaacctttaacttaacgtttacgttaaccgtaaaactacggttaaccgtttaaccccgtttccccgtaccccccgggtacgttccggtaacccggaaaccgggtaaaccgtaaacgggtaacggttaaacgaaacgtaaacggaaccggtaaacgttacgggtacgtcgttaccggttccgaaacccgtaactttacggttccgtttaccgttccttaaccgttccctttccccggttaacccc

SEQ ID NO: 364864 - DNA, 584 bp, Homo sapiens
  misc_feature: GZ8MTXP01AD34V.13.53.E09.1.454.CMB.2.raw
  modified_base (259)..(259): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtcttcgtctctcggagacagggtcaccatcacttgtcgggcaagtcagaacattggcaactctttaaatggtancagcagaagtcagggcaacgccccgaaacctcctgatctacggtacactccactttgcacagtggatcccgatcaaggttcagtggaacaggtgatcgtaggaacagtacttttacccacaccgatacgaggggttctacgagacctagaacgtatttacgcgtaacttactattcggtactaactagtaactttaccgttccgtacccccggtacgtttaccggccgaaacgggtaccgaaacgggtaggaaactacgttaaaggacgaaacgtggtacggcgttcgcaaccgtatcttcgtcttctaacgttccttaaccccg

SEQ ID NO: 364865 - DNA, 537 bp, Homo sapiens
  misc_feature: GZ8MTXP01D97O1.13.53.E09.1.454.CMB.2.raw
  modified_base (348)..(348): a, c, t, g, unknown or other
  modified_base (371)..(371): a, c, t, g, unknown or other
  modified_base (500)..(500): a, c, t, g, unknown or other
  modified_base (515)..(515): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggacaagccccgaacctcctgactctacggtacatcctactttgcacagtggactccatccaaggttcagtgcaagtagntctaggaacagtacttttacccncaccctatcgagggtctacgagcctagaagtatttggactacttactattgtacaacagtacgttaccttctccccggtacgtcgtaccgaacggtaaccgaagtaggaataacgaagacgacgttagnggtcttcgcacaatntctctcttactccttccgtccc

SEQ ID NO: 364866 - DNA, 545 bp, Homo sapiens
  misc_feature: GZ8MTXP01DF3IC.13.53.E09.1.454.CMB.2.raw
  modified_base (354)..(354): a, c, t, g, unknown or other
  modified_base (376)..(376): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcggcaagtcagaacattggacaactctttaaattggtatcagcagaagtcagggcaacgccccgaactcctgactctacggtacatcctactttgcacgagtcggactcccatccaaggttcagtggacaagtagntctaggaactagtactttaccncacatcgagggtctacgacgctagtaagttatttcgacgtacttactattcgtacaactagtacgttacccttccgtccccggtacgttccggaccgaacgggtacccaagggtacgaaatcgaaagcgaaacttgtagcttgcacaatctgtctcatccgttcccgtc

SEQ ID NO: 364867 - DNA, 572 bp, Homo sapiens
  misc_feature: GZ8MTXP01BQBAW.13.53.E09.1.454.CMB.2.raw
  modified_base (345)..(345): a, c, t, g, unknown or other
  modified_base (369)..(369): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaactcctgactctacggtacatccatttgcacagtggatcccatcaaggttcagtgcaagtagntctaggaactagtacttttacccnaccatcgagggtctacgagcctagaagtatttgacgtacttactattgtactaaactagtaacgttaccttccgtcccccggacgttccggaccgtaacggtaccgaaacggttacggaaagtaacgaacgacggaaccgttagttacgggcgttacgcgttaaccctaatcttcgttcttcttacttccgttccccgttccc

SEQ ID NO: 364868 - DNA, 545 bp, Homo sapiens
  misc_feature: GZ8MTXP01EF3OV.13.53.E09.1.454.CMB.2.raw
  modified_base (371)..(371): a, c, t, g, unknown or other
  modified_base (510)..(510): a, c, t, g, unknown or other
  modified_base (521)..(521): a, c, t, g, unknown or other
  modified_base (526)..(526): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaaagtcagaacattggcaactctttaaattggtatcagcagaagtcagggcaagccccgaactcctgatctacggtacatccactttgcacagtgggatcccatccaaggttcaagtggcaagtagaatctagggaacagattttacccnctacccatcaggggtctacagcctagaagtattttggactacttactaattgtactaaacagtaacgtttaaccttcctcccccggacgttcggaccgtaacggtacgaacggtagggaaataacaacgagacgttagngtattcgcacntactntcttcactccttccgtccc

SEQ ID NO: 364869 - DNA, 683 bp, Homo sapiens
  misc_feature: GZ8MTXP01C7BTG.13.53.E09.1.454.CMB.2.raw
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacgagggtccaccatcacttggtcgggacaagtcaagaactattggacaacttactttaaattggtatcagcagagtcagggcaacgccccgaacctctgactctacggtacactcctactttgcacgaggtcggactccataccgaaggttcgagtgctaaagtagntctagggaaactagtactttacccacacctatacggacggggtactacgacgtaccgtagtaacgttatttcggacttaacttacgttaattcgtaactaaacgtaacgttaaccgtttaccccgtttcccgtaccccccggtaacggtttccggaaacccggtaaacggggtaaacccgttaaaggggtacggtaaaaacgttaacggaaacggttaccggtaaacgttcggggtacggtcgttacggaccttaacccgtaacttaccgttcggtttacccgttacttaccgtttccccttttccccggtaaccc

SEQ ID NO: 364870 - DNA, 561 bp, Homo sapiens
  misc_feature: GZ8MTXP01BYUJ9.13.53.E09.1.454.CMB.2.raw
  modified_base (349)..(349): a, c, t, g, unknown or other
  modified_base (372)..(372): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaactcctgatctacggtacatccactttgcacgagtggactcccatccaaggttcagtggcaagtagntctaggaacagtacttttacccncaccatcgaggggtctacgagtcctagtaagtattttgacgtacttactattgtacaactagtacgttaccttccgtacccccggtacgtcggaccgaacgggtaccgaaggtaggaaagtaacaacgacgaacgttgtacggtcgttcgcgacctaagtctcgttctcgttactccttcccgtaaccc

SEQ ID NO: 364871 - DNA, 624 bp, Homo sapiens
  misc_feature: GZ8MTXP01A45ZT.13.53.E09.1.454.CMB.2.raw
  modified_base (197)..(197): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggcaagtcagaacattggcaaactctttaaattgaatcagcagaagtcagggcaaagccccgaactcctgatctacggtacatccactttgcacagtggatccactccaaggttacagtggcaagttaagaatacgtacgaacgtacgtactttacctactactactacgtacgggtacgtacgacgtacgtagtaagtaagtttacgtacgtaacttaacttaacgttacgtaacgtaaacgtaacgtaacgttaaccgttacccgttaccccggtaccggtaccggtaccgtaaccggtaaccggtaaacggtaacggtaaacgtaacgtaacgttaacgtaacgttacgtacggtcgttcgcgacgtaactactcgttcttcttactccgttcccgtaaccg

SEQ ID NO: 364872 - DNA, 534 bp, Homo sapiens
  misc_feature: GZ8MTXP01BCK1F.13.53.E09.1.454.CMB.2.raw
  modified_base (342)..(342): a, c, t, g, unknown or other
  modified_base (346)..(346): a, c, t, g, unknown or other
  modified_base (368)..(368): a, c, t, g, unknown or other
  modified_base (393)..(393): a, c, t, g, unknown or other
  modified_base (504)..(504): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacagtggactcccccatcaagttcagtgcngtanatctaggaacagactttacccncactatcagggtcacagctgaagtntttgcgtacttactaggttctacaactagtacttaccttccgtccccggacgtcggtaccgaacggaccgaaggtaacgaaacgttacgaacgacgaacgtagttcgggcncgtcacaactctcgttctcttaacgttccc

SEQ ID NO: 364873 - DNA, 488 bp, Homo sapiens
  misc_feature: GZ8MTXP01BGN4J.13.53.E09.1.454.CMB.2.raw
  modified_base (220)..(220): a, c, t, g, unknown or other
  modified_base (428)..(428): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgacccagtctccatcctccctgtctgcatctcttggagacagagtcaccgtcacttgccggnagtcacgacattaacacttatttagcctggtatcagcagaagccagggagagtccctaaattattgatctctgctgcgtccgcctttgcaatcgggggtcccatcctcggttcagtggcggtggatcgtagacagattcactctcaccatcacaactgcaccctgagatgttgaacgttattactggtcagacctatagtggtgccgntctatttcggcggtaggccaaggttgcagatcaaacgcttgtggctgcacatcttgttcc

SEQ ID NO: 364874 - DNA, 571 bp, Homo sapiens
  misc_feature: GZ8MTXP01CZ10Z.13.53.E09.1.454.CMB.2.raw
  modified_base (397)..(397): a, c, t, g, unknown or other
  modified_base (547)..(547): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagaactattggactaacttctttaaatggtatcagcaagaagtcgagggacaacgccccgaactcctgactctacggtacactccactttgcacgagtggactcccccatacgtaaggttcaggtcggactaaggtagtatcgtaggaaccagttactttacccnaccatcgagggtctacagctagaacgtattgacgtacttactagttcgtactaatacgtacgttacccgtcctccccggtacgttcgaccgaacggacgaagggtaagaaattacgaacgacgtaagtcgagggttcacgaacctaacgnttcgtattcttcgttaacttcccg

SEQ ID NO: 364875 - DNA, 629 bp, Homo sapiens
  misc_feature: GZ8MTXP01CDECC.13.53.E09.1.454.CMB.2.raw
  modified_base (364)..(364): a, c, t, g, unknown or other
  modified_base (391)..(391): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcggcaagtcagaacattggacaacttctttaaattggtatcagcagaagtcagggcaacgccccgaactcctgactctacggtacatccctactttcgcacgaggtcgggactccccataccgtaaggttcaggtggcaaagtagntcgtaggaaactagtacttttaccccncacctacgtacgaggggtcctacgacgtccctaggtaacgttatttcgacgttactttaacttatttacgtacgtaaacgtacgttaaccgtttaccccttccccgtacccccggtaccggttccgtaaccgaacgggtaaccgtaaggtacggtaaactaacgaacggacgtaacgttggtacggtcgttcggccactaacgtcttaacgttctcttacttccgttccccgtaaccc

SEQ ID NO: 364876 - DNA, 649 bp, Homo sapiens
  misc_feature: GZ8MTXP01C1UXB.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactcttaaatggtatcagcagaagtcgagggacaacgccccgaacctcctgactctacggtacactccactttgcacgagtcggactcccatccaaggttcagtgcaagtagaatctaggaaactagtacttttacccacacccattcgaggggtactacgacgcctagtaaagtattttacgacgttaacttacttaatttacgtactaaacgtagtaaccgtttaccccgttacccgtcccccgggtaaccgtttccgggaacccgtaaacggggtaaccccgaaagggttaccggaaaagttaacccgtaaagaccggtaaaacttcgggttaacgggctttacgggccaccgtaacttccgttcggtttcctttcgttaacctttcccgtttcccccggtaaccc

SEQ ID NO: 364877 - DNA, 541 bp, Homo sapiens
  misc_feature: GZ8MTXP01D7BH9.13.53.E09.1.454.CMB.2.raw
  modified_base (354)..(354): a, c, t, g, unknown or other
  modified_base (492)..(492): a, c, t, g, unknown or other
  modified_base (505)..(505): a, c, t, g, unknown or other
  modified_base (509)..(509): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcgagggcaacgccccgaacctcctgactctacggtacactcctactttgcacgagtggactccatcctaaggtcagtgacaagtagntcgtaggaactagtacttttacccactacctatacgtagggtctacgagcctagaagttatttcgacgttacttatattgtacaaactagtacttaccttcctccccggtgtcgaccgaacggacgaagtagaataanagacgaacgttgngtcncgcactaagtctcgtctcttactccttccgtc

SEQ ID NO: 364878 - DNA, 623 bp, Homo sapiens
  misc_feature: GZ8MTXP01C1ROK.13.53.E09.1.454.CMB.2.raw
  modified_base (298)..(298): a, c, t, g, unknown or other
  modified_base (361)..(361): a, c, t, g, unknown or other
tcagtcacgtactacacgaccggtgctcgatttagagagagtgtgttgggtttgggggagtcagtctcagtcaggacacagcatggacatggagggtccccgctcagctcctggggctcctgctactctggctccgaggtgccagatgtgacatccagatgagccagtctccatccaccctgtctgcgtctcgtcggagacagggtcaccatcacgttgtcgggacaagtcaagaactagttggactaacttactttaaatggtatcagcaagagtcgaggcaacgccccaacctccngactctacgtacatcctactttgcacgagtggactccataccgaaggttcagtggcaagtagntacgtaggaaactagtactttacccacaaccatacgacgggtactacgacgtccgtagtaagtattttagacgttacttaactattacgtactaaacgtagttaaccgtttaccccgttcccgtacccccggtacgtttccggacccgaaacgggtacccgaaagggtacggaaattaacgaaacgcggtaaacgttggttacggcttcgccaccgtaacttcctcgtttcttacccttactttccccgttccccgtaaccc

SEQ ID NO: 364879 - DNA, 547 bp, Homo sapiens
  misc_feature: GZ8MTXP01DA3HE.13.53.E09.1.454.CMB.2.raw
  modified_base (375)..(375): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcattgtcgggcaagtcagaacattggacaactcttaaatggtatcagcagagtcagggcaacgccccgaactctgactctacggtacatcctacttgcacagtggactcccccatcgaaggttcaggtgacaagtagatctaggaactagtactttacccncacatcgagggtctaacgacgtcctagaagtatttcgacgtactttactatttcgtacaaactagtacgttaccctccgtccccggagttccggaccgtaagggacccaaagggtggaaattcgaaagcgaaactggttaggcttcgcacctaatctgttcttcaattcccg

SEQ ID NO: 364880 - DNA, 598 bp, Homo sapiens
  misc_feature: GZ8MTXP01CYGCZ.13.53.E09.1.454.CMB.2.raw
  modified_base (347)..(347): a, c, t, g, unknown or other
  modified_base (374)..(374): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttgtcgggcaagtcagaacattggacaactctttaaatggtatcagcagagtcagggcaacgcccgaactcctgactctacgtacatcctactttgcacagtggatcccataccaggttcaggtcgcaagttagngtctagggaaactagtacttttacccncaccatcgagggtctacagctagattatttgacgtacttactattcgtactaactaggtactttacccttccgtacccccggtacgtttccggacccgtaaagggaacccgtaaagggtacgggtaaactaacgaaacggacgtaaaccgttgttacgggcttacggcttaacccctaatcctttccggttactttacgttacctttcccgttttcccccgtcc

SEQ ID NO: 364881 - DNA, 576 bp, Homo sapiens
  misc_feature: GZ8MTXP01D09EO.13.53.E09.1.454.CMB.2.raw
  modified_base (349)..(349): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaactcctgactctacggtacatccactttgacacaggtggatcccatccaaggttcagtgacaagtantctaggaaactagtactttacccacacctatcgagggtcacgagtcctagaagttatttgacgtacttactattagtacaaacgtagtacgtttacccttccgtacccccggtacgttccggaccgaacgggtaacccgaagggtacggaaataacgtaaacgcgtaaacgttgtcggtacgttcgcacctaacttcgttcgttcttcaccttccgttcccgtaacc

SEQ ID NO: 364882 - DNA, 633 bp, Homo sapiens
  misc_feature: GZ8MTXP01CUNS1.13.53.E09.1.454.CMB.2.raw
  modified_base (290)..(290): a, c, t, g, unknown or other
  modified_base (353)..(353): a, c, t, g, unknown or other
  modified_base (381)..(381): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttgtcggcaagtcagaacattggacaactctttaaattggtatcagcaagaagtcagggcaacgccccgaactccngactctacggtacatccactttgcacagtggactcccgataccgaaggttcagtgacaagtanaatcgtaggaaactgtaacttttacccnctaaccgattcgacggggtactacgagtaccctagaagtattttcgacgtacttaactattaggtactaaacgtaagtacgtttacccgttccgtacccccgtacggtttccgacccgtaaacggggaaacccctaaagggttaccggaaaagttcccgtaaaaggccgaaaaccgttgggtaacggtcgttacgttcgaaccctaataccttcggttccttacgttaccttaacccgttcccgttaacccc

SEQ ID NO: 364883 - DNA, 663 bp, Homo sapiens
  misc_feature: GZ8MTXP01C5WH2.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcaggcaacgccccgaacctcctgactctacggtacacgtcctactttcgcacgagtggactcccataccgaaggttcaggtcggactaaagtagaactacgtagggtaaacacgtaacttttaacccctctaaccctatcgtaacggggttactacgacgtccctaaggtaaagttacgttttagacgttaactttaacttaactttacggttactaaactaacggttaccgtttaacccgttcccgttacccccggtaccgtttccggacccgaaacggggtaaccctaaaggggtaacggaaaacttaacgaaacggacgtaaacgttcggtacggacgttacggccaaccgttaactccgttcgttccttacttacttcccttccccgtaacc

SEQ ID NO: 364884 - DNA, 571 bp, Homo sapiens
  misc_feature: GZ8MTXP01CKC6I.13.53.E09.1.454.CMB.2.raw
  modified_base (347)..(347): a, c, t, g, unknown or other
  modified_base (370)..(370): a, c, t, g, unknown or other
  modified_base (390)..(390): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaacttctttaaatggtatcagcagagtcagggcaacgccccgaactcctagactctacggtacatccactttgcacagtggatcccatccaaggttcagtgcaagtagntctaggaactagtactttacccncaccatcgacgggtctacgngctagaacgtatttcgacgttacttactattgtacaactagttacgttacccttcccgtcccccggtacgttccggaccgaacgggtaccgtaagggtacggaaataacgaacggcgtaaacttggtacgggcttggccttacgtaactcttaacgtcttcgacttcccgttcccgtaacc

SEQ ID NO: 364885 - DNA, 638 bp, Homo sapiens
  misc_feature: GZ8MTXP01BY6TH.13.53.E09.1.454.CMB.2.raw
  modified_base (351)..(351): a, c, t, g, unknown or other
  modified_base (374)..(374): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaacttctttaaattggtatcagcagaagtcagggcaacgccccgaactcctgactctacgtacatccactttgcacaggtggactcccatccaaggttcaggtggacaagtagntcgtaggaacagtactttacccncaccatcgacggggtctacgagtacctagtaagtatttacgacgtactttacgtatttacggtactaaactaacggttaccgtttaacccgtttcccgttccccccgggtaccggtttcccggaacccggtaaacggggtaacccggtaaacgggttacgggaaacgttaacgaaacggaccggtaaaccgttgggtacggtcgttacggccttacccgtaacttccgttcgttccttccttaccttccctttccccgtccccg

SEQ ID NO: 364886 - DNA, 571 bp, Homo sapiens
  misc_feature: GZ8MTXP01EDT63.13.53.E09.1.454.CMB.2.raw
  modified_base (369)..(369): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcaggcaagccccgaactcctgatctacgtacatccactttgcacagtggactcccatccaaggttcagtggcaagtagaatctaggaaacagtactttacccncaaccatcgaagggtctacgagcctagaagtattttgacgtaactttactatttgtactaaaactaggttacgtttaaccccttccgtacccccggtaacgtttccggaaccgtaaacggggtaccaaagggttcggaaataacgaaagacgtaaacgttgtacgggcttggcacctaatctgttactcatccttccgaacc

SEQ ID NO: 364887 - DNA, 576 bp, Homo sapiens
  misc_feature: GZ8MTXP01CE10K.13.53.E09.1.454.CMB.2.raw
  modified_base (348)..(348): a, c, t, g, unknown or other
  modified_base (370)..(370): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaacctcctgactctacggtacatccatttgcacagtggatccatccaaggttcagtggcaagtagntctaggaacagtattttacccnaccatcgagggtctacgacgcctagtaagtattttacgacgtactttaactatttacggtactaaacgtaagttacgtttaacccttccgttcccccggtacgttcggtacccgaagggaaccgtaaggtacggaaacgttaacgaaacgacgtaaacgttgtagggtcttggcacgaatcctaagtctcttactcttccgtaacc

SEQ ID NO: 364888 - DNA, 641 bp, Homo sapiens
  misc_feature: GZ8MTXP01BWFWJ.13.53.E09.1.454.CMB.2.raw
  modified_base (351)..(351): a, c, t, g, unknown or other
  modified_base (376)..(376): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaactcctgactctacggtacatcctactttgcacgagtggactcccatccaaggttcagtgcaagtagntcgtaggaactagtacttttacccncactatcgagggtctacagtcctagtaagtattttcggactacttactatttacgtacctaaacgtaggttaccgtttaccccgtttacccgtacccccgggtacggttaccggtacccggtaaacggggtaaccggtaaacgggtaacgggtaaacgttaaccgaaacggacggtaaccgttaggtacgggtcgttacggccgttacccgtaacttccgttcggtttcccttacgttaccgtttccccttccccggttaacccg

SEQ ID NO: 364889 - DNA, 551 bp, Homo sapiens
  misc_feature: GZ8MTXP01BYSAO.13.53.E09.1.454.CMB.2.raw
  modified_base (352)..(352): a, c, t, g, unknown or other
  modified_base (377)..(377): a, c, t, g, unknown or other
  modified_base (507)..(507): a, c, t, g, unknown or other
  modified_base (514)..(514): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagaacattggacaactctttaaatggtatcagcagaagtcagggcaacgccccgaactcctgactctacgtacatcctactttgcacagtcggactcccatccgaaggttcagtgcaagtacgntcgtaggaactagtactttacccanacatcgagggtctacagctagaagtatttcgactacttactattcgtactaaactagtaacgttacccttccgtccccggtacgtcgtaccgaacggaaccgaaggtacggaagtaacaagacgaaacgngtcgtcncgcaccaatctaacgtcttcttactccttccgtaacc

SEQ ID NO: 364890 - DNA, 716 bp, Homo sapiens
  misc_feature: GZ8MTXP01C9HSQ.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgaagccagtctccatcccaccctgtctgcgtctcgtcggagacgagggtcaccatcacttggtcgggacaagtcaagaactagttggactaactactttaaattggtatcagcaagagtcgagggacaacgccccgaacctctagactctacggtacatccactttgacacgagtcgggactaccccataccgaaaggtttcaaggttgggactaaaggttaagaagttccgtaaggggaaactaggttaaccttttaaccccacgtaaccctaagtttaccgaacggggttaccttaaccgaacgtcccgttaaggtaaacgttagtttttacggaccggttaactttaaccgttaatttacggttactaaacgttaacgggtaacttttaaaccccgttcccgttaccccccgggtaaccgttttcccggaacccggtaaaccgggaaccggtaaacggttaacgggaaaacttaacgaaacggacgtaaaccgttgttaacggcgttgaccacctaactcgtcgttcctacttactttcctttccccgtaaccc

SEQ ID NO: 364891 - DNA, 569 bp, Homo sapiens
  misc_feature: GZ8MTXP01BZFYZ.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaacttctttaaattggtatcagcagaagtcgagggcaacgccccgaacctcctgactctacggtacatccactttgcacagtcggactcccccatcaaggttcagtggcaagtagatcgtaggaacagtacttttacccctacaccagtcgaggggtctacgacgcctagaacgtatttgacgtaacttacttagttgtactaacagtacgttacccttccgtaccccggtacgttccggaccgaacgggaccgaagggtcggaaattcgaaacgcgtaaacgtgttaggcttgccactaacgtctgttaccttcttaacgttcccg

SEQ ID NO: 364892 - DNA, 623 bp, Homo sapiens
  misc_feature: GZ8MTXP01CEQQO.13.53.E09.1.454.CMB.2.raw
  modified_base (359)..(359): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaacttctttaaattggtatcagacagaagtcgagggcaacgccccgacctcctgactctacggtactactcctactttgacacgtaggtggactccatcctaaggtcaggtggacaagtangtctaggtaactagtacttttacccgactacctacgtcgagggtactacgacgtacctagaacgttatttcgtacgtactttaacttattacgtactaacgtaacggttacctttacccgttcccgtacccccggtacgttccggtaaccgaaccggtaaccgtaacggtacgtaaacgtaacgaaacgaccggtaaacgttgtaacgggcttacggccaccgtaagtcttcgttcctaccttaccttcccgttcccgtaaccg

SEQ ID NO: 364893 - DNA, 636 bp, Homo sapiens
  misc_feature: GZ8MTXP01EYGS8.13.53.E09.1.454.CMB.2.raw
  modified_base (196)..(196): a, c, t, g, unknown or other
  modified_base (288)..(288): a, c, t, g, unknown or other
  modified_base (301)..(301): a, c, t, g, unknown or other
  modified_base (349)..(349): a, c, t, g, unknown or other
  modified_base (372)..(372): a, c, t, g, unknown or other
  modified_base (378)..(378): a, c, t, g, unknown or other
tcagtcacgtactacacgaccggtgctcgatttagagagagtgtgttgggtttgggggagtcagtctcagtcaggacacagcatggacatgacgggtccccgctcagctcctggggctcctgctactctggctccgaggtgccagatgtgacatccagatgagccagtctcatccacctgtctgcgtctctcgganacagggtcaccatcacttgtcgggcaagtcaagactattggacaactcttaaattggtaatcagcagagtcagggcaacgcccgaaactccngactctacggtanatccatttgcacaggttggactcccatccaaggttcagtgcaagtagntctaggaactagtacttttaccnaacctnacgtacgggtctacgaggaccttagaagttattttcggactacctttactaagttcgttacgaaacttacgggtactttaacccgttaccgtcccccggtacgtttacggaccgtaagggtaacccgaacgggttaacgggaaattaaccgtaaaggaccgtaaacggtttagtcggggtaacccgttacgttacgttaccgtaacgttaccgttaacgttaccgttaccgttaccgttaacccgttcccgtaacccg

SEQ ID NO: 364894 - DNA, 560 bp, Homo sapiens
  misc_feature: GZ8MTXP01EKNUI.13.53.E09.1.454.CMB.2.raw
  modified_base (357)..(357): a, c, t, g, unknown or other
  modified_base (385)..(385): a, c, t, g, unknown or other
  modified_base (407)..(407): a, c, t, g, unknown or other
  modified_base (505)..(505): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggacaactcttaaattggtatcagcagaagtcagggcaacgccccgaactcctgatctacggtacatccactttgcacagtcgggatccccataccgaaggttcaggtggactaaagtagntcgtagggaaactagtacttttaccccncacctatacgaggggtctaacngcctagaagttatttcgcgtacttactattcgtacaactagtacgtttacctccgtcccccggagttcggtaccgaacggtaacgaacggtacggaanaacaacgacgacttagtgtcttgccactaatctgtctcttactcttcccgtaacc

SEQ ID NO: 364895 - DNA, 624 bp, Homo sapiens
  misc_feature: GZ8MTXP01A4W50.13.53.E09.1.454.CMB.2.raw
  modified_base (378)..(378): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacatggcaactcttaaattgatcagcagaagtcaggacaacgccccgaacctcctgactctacggtacatccactttgcacgagtggactccccgatcgaaggttcagtgcaagtagatcgtaggaactagtacttttaccccncaacctagtaccgaggggttacctacgagtcccgtagtaacgttagttttagaccggtaactttacctatttacggttacaaacctacggtaccgtttaacccgttcccgtaccccccgggttaacggttacccgggtaccggaaacgggaacccgtaaagggttaacgggaaattacgaaacgacggaaaccgtggttcgcgttcggaacaccctaactaccttcttaccttcttaacgttcccg

SEQ ID NO: 364896 - DNA, 601 bp, Homo sapiens
  misc_feature: GZ8MTXP01DV3UJ.13.53.E09.1.454.CMB.2.raw
  modified_base (223)..(223): a, c, t, g, unknown or other
  modified_base (356)..(356): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtccacatcacttggtcggnaagtcagaacattggacaacttctttaaattggtatcagcagaagtcagggcaacgccccgaactcctgactctaccggtacatcctatttcgcacgaggtggactcccataccaaggtttcagtgcaagtantcaggaaacagtactttacccacaccagtcgagggtcacagctagaagttatttcgcgttaacttactattcgtacaacgtacgtacgtttaaccccttccgtacccccggtacggttaccggaaccgtaaacgggggaacccgtaaagggtaacgggtaaactaacgaaaggacgtaaaccgttggtacgggtcttacggaccacgaactttactcgttctacttaccttccttaaccccgtcc

SEQ ID NO: 364897 - DNA, 576 bp, Homo sapiens
  misc_feature: GZ8MTXP01CUTUA.13.53.E09.1.454.CMB.2.raw
  modified_base (349)..(349): a, c, t, g, unknown or other
  modified_base (372)..(372): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggactaactctttaaatggtatcagcagaagtcagggcaacgccccgaacctcctgatctacggtacatccactttgcacagtggactccataccaaggttcagtggcaagtagntctaggaacagtacttttacccncaccatcgagggtctacgagcctagaagtatttgcgttacttactattcgtacaactacgtacttacccgttcctacccccggtacgttccggaccgtaacgggaacccgtaaggtacggaaagtaacgaaacgacggtaaaccgttggtacggcgttcggccacctaacttctcgttccttcttacttccttccccgtaaccc

SEQ ID NO: 364898 - DNA, 565 bp, Homo sapiens
  misc_feature: GZ8MTXP01BYLSX.13.53.E09.1.454.CMB.2.raw
  modified_base (351)..(351): a, c, t, g, unknown or other
  modified_base (375)..(375): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggacaagtcagaacattggacaacttctttaaatggtatcagcagaagtcagggcaacgccccgaactcctgatctacggtacatcctactttgcacagtggactcccatcccaaggttcagtgcaagtantcgtaggaactagtactttacccncacatcgagggtctacagcctagtaagtatttgacgtacttactattgactaactagtacctttaccttcccgtccccggtacgtccggtaccgaacggtaaccgaacggtacggaacgtaacgaaacgacgtaacgttagtcgcgttcgcgttacaactcgtcgtcttcttactccgttcccgtaaccc

SEQ ID NO: 364899 - DNA, 574 bp, Homo sapiens
  misc_feature: GZ8MTXP01DZ7AG.13.53.E09.1.454.CMB.2.raw
  modified_base (342)..(342): a, c, t, g, unknown or other
  modified_base (366)..(366): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccatttgcacagtggatcccatccaaggttcagtgcaagtanaatctaggaacagtactttacccncaccatcaggggtctacgagcctagaagtatttgacgtacttactatttgtacaaacgtagtaacgtttacccttccgtacccccggtacgttaccggtacccggaacgggtaacccgaacggttacggaaacgtaacgtaacgacggtaacttaggtcggtcttcggcaccaactcgtcttcttacttacttccgttcccgtaaccc

SEQ ID NO: 364900 - DNA, 723 bp, Homo sapiens
  misc_feature: GZ8MTXP01DW6QJ.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcggcaagtcaagaacattggactaacttactttaaattggtatcagacagaagtcgagggacaacgcccccgaactcctgactctacgtacactacctactttgcaacgaggttacggactcccctaatacccgtaaaggttcaaggtggaccaaaggttaagaagttaccgtaagggaaacctaagttaacctttttacccacctaacctagttccgtaacggggttacctaacgacgtacccgttaggtaaacgtttagttttacggaccgttaactttaacttaagtttctaacgtaaaccgttaacggttaacccgtttaacccctttaccccggtaccccccggtacggtttaccggaacccggtaacgggaaccggtaaaccggtaagggtaaacgttaacgtaaacggaccggtaaacgttaacggtcggtacgttacggccacccgtaatacccttcggtttacctccttaccgttcccgttttccccgtaaccccg

SEQ ID NO: 364901 - DNA, 535 bp, Homo sapiens
  misc_feature: GZ8MTXP01CCXP5.13.53.E09.1.454.CMB.2.raw
  modified_base (347)..(347): a, c, t, g, unknown or other
  modified_base (371)..(371): a, c, t, g, unknown or other
  modified_base (401)..(401): a, c, t, g, unknown or other
  modified_base (498)..(498): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcaagaacattggacaactctttaaattggtatcagcagaagtcagggcaacgccccgaactctgactctacgtacatccactttgcacagtggactccatccaaggtcagtgcaagtagntctaggaaactagtactttacccncaccatcgagggtctacagcctagaacgtntttgacgtacttactattcgtacaacgtagtactttacccttccgtccccggacgttcggacctaagggaccaagggtgaaatcgaagcgtaaacgngtacgcttagcaccgaatcctgtctcatccttccgcc

SEQ ID NO: 364902 - DNA, 637 bp, Homo sapiens
  misc_feature: GZ8MTXP01A3D8R.13.53.E09.1.454.CMB.2.raw
  modified_base (285)..(285): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttgtcgggcaagtcagaacattggcaactctttaaatggatcagcagagtcaggcaagccccgaactcngatctacggtacatccactttgaccacgagtggggactcccccatcgtaaaggttccaaggttcgggctaaggtagacgttcgtaggggtaaacctaggtaactttttaaccccacgtaaccctagtccgtaagggggtacctaacgtacgtccgttagaacgttatttcgggaccttaactttaaccgttagtttcgttaaccaaacgtagtaccgttaaccttccccgtaccccggtaccgttccgtaccggtaaccggaaccggtaacggtaaggaacgttacgaaacgaaccgtagttcgcgttcgactaaccgactaacgtgttccttctaagttcccttaaccccg

SEQ ID NO: 364903 - DNA, 749 bp, Homo sapiens
  misc_feature: GZ8MTXP01EPGZV.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacgagggtcaccatcacttgtcggcaagtcaagaactattggactaacttactttaaagttggtaatcgagacaagaacgtcgaagggcaaccgccccgaacctcctgactcgtaacgtacactcctactttcgacacgagtaggactaccccaatacccgtaaaggttcgaaggttcggactaaagttaagtcgttacgtaacgggaaacttaacggtttaaccttttttaccccgacctaacccgtaacgttaccggtaacggggttacctaaacgacggttacccgtaaggtaaagtttacgttttacggaccgttaactttaaaccgttaagtttaacgttaaccggtaaaacgtaacggtttaaacccgtttaaccccgtttacccggttacccccccgggtaagtttacccggaaccgggtaaaccggtaaaccggtaaacggtaaacgggtaaacgtaaacgtaacgacgtaaccgttaggtcggtacgttacgccttacctaacgtacgttcgttcttccttacttaacccttcccgttaacc

SEQ ID NO: 364904 - DNA, 670 bp, Homo sapiens
  misc_feature: GZ8MTXP01BAWCY.13.53.E09.1.454.CMB.2.raw
  modified_base (596)..(596): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtcaccatcacttggtcggacaagtcaagaactagttcggactaaacttactttaaaagttggtatacaggacaaggaagtcgaagggaccaaaccggcccccgaacctcctagtactccgtaacggtaaccacttccctacttttcgacacgtagtacgggactcccataccgaaggtttacgaggtcggactaaagtagaatcgtaagggaaactacgtaccttttacccactaccatacgtaggggtacctaacgacgtcgtaagtaacgttagtttcgaccgttaacttaaccttattacgtaactaaacgtaacgttaccgttacccgttcccgtacccccggtaccgttcgaaccgtaacggtaaaccgtaacggtaacggtaaanaacgtaacgacgtaacgttacggtcggtacgttcgcaccgtaatactcttctcttaccttccttcccgtaaccc

SEQ ID NO: 364905 - DNA, 579 bp, Homo sapiens
  misc_feature: GZ8MTXP01CGXXP.13.53.E09.1.454.CMB.2.raw
  modified_base (349)..(349): a, c, t, g, unknown or other
  modified_base (376)..(376): a, c, t, g, unknown or other
  modified_base (409)..(409): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaactcctgatctacggtacatccactttgcacagtggactcccatcccaaggttcaggtggcaagtagntctagggaaactagtacttttaccccncacctatcgaggggtactacgagcctagaagtnttttcgacgtacttacttattgtacaactagtacgttacccttccgtcccccggtacgttccggaccgaacgggtaccgaaagggttaggaaacgttaacaaacggcggtaaacttcggttaggcgttggccacctaatctgttccttacacgtttccttcccgtaaccc

SEQ ID NO: 364906 - DNA, 682 bp, Homo sapiens
  misc_feature: GZ8MTXP01EWN7J.13.53.E09.1.454.CMB.2.raw
  modified_base (380)..(380): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacgttgtcgggcaagtcaagaactagttcggactaacttactttaaattggtatacagacaagaagtcgaggaccaacgaccccgaacctctagactctacgtacactccctactttcgacacgaggtcggactacccccatacgtaaggtcaggtgacaagtanatcgtaggaactacgtacttttacccactaacctatacggtagggtctaacgacgtaccgtagtaacgttagtttcgaccgttaactttacctagttacgtaacgtaaactacgttaccgtttacccgttcccgttaccccggtacggttccgaaaccgggtaaccgggaaccggtaaacgggtaacggtaaacgttaaccggaaacggttaaccggtaaacggttacggttcgggttacgttacgaacccggaccgttaacttcggttaccgttcccttaacgtttcccgtttaacccccg

SEQ ID NO: 364907 - DNA, 580 bp, Homo sapiens
  misc_feature: GZ8MTXP01BNEHQ.13.53.E09.1.454.CMB.2.raw
  modified_base (350)..(350): a, c, t, g, unknown or other
  modified_base (372)..(372): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaactcctgatctacggtacatccactttgcacgagtggatcccgatccaaggttcaagtggcaagtagntctaggaacagtactttacccnaccatcgagggtctacgagcctagaagtattttgcgtacttactatttgtactaaacgtagtacgttaccttccgtacccccggacgttcgaccgtaacggaacccgtaaggtaacggtaaagtaacgtaaacgacggtaaacttcgtagggcttcggttccactaacttcgttcgttacttccttaacttcccttcccggtaacccg

SEQ ID NO: 364908 - DNA, 555 bp, Homo sapiens
  misc_feature: GZ8MTXP01A20C2.13.53.E09.1.454.CMB.2.raw
  modified_base (352)..(352): a, c, t, g, unknown or other
  modified_base (375)..(375): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaacttctttaaattggtatcagcagaagtcgagggcaacgccccgaacctcctgactctacgtacatcctactttgcacagtggactcccatccaaggttcagtgcaagtagntctaggaactagtactttacccncaccatcgagggtctacacgctagaagtatttcgacgtacttactattagtacaaactagttacgttacccttcccgtccccggtacgttccggaccgaacggtaaccgaaggtacgaaataacgaagacgtacgttgtcgcttcgcacctaatctcgtctcttactccttcccgtaacc

SEQ ID NO: 364909 - DNA, 575 bp, Homo sapiens
  misc_feature: GZ8MTXP01B16CO.13.53.E09.1.454.CMB.2.raw
  modified_base (252)..(252): a, c, t, g, unknown or other
  modified_base (352)..(352): a, c, t, g, unknown or other
  modified_base (376)..(376): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactcttaatggtatnagcagaagtcaggcaacgccccgaacctcctgactctacggtacactcctactttgcacgagtgggactcccatccaaggtttcaaggtggacaagtagntctagggaacagtacttttacccncacctatcgacggggtctacgacgcctagaagtattttagcgtaacttactattacgtcaaactagtaccgtttaaccttcccgtcccccggtagttccggaccgaacggtaaccgtacgtaacggaataacgtaacgacgtacttacggtggtcttcgccactaactcgtcgttaccttcttactccttcccgtaacc

SEQ ID NO: 364910 - DNA, 621 bp, Homo sapiens
  misc_feature: GZ8MTXP01CH74Z.13.53.E09.1.454.CMB.2.raw
  modified_base (351)..(351): a, c, t, g, unknown or other
  modified_base (378)..(378): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaactcctgatctacgtacatccactttgcacagtcggactccataccgaaggttcaggtggacaagtagntctagggaaactagtacttttaccccnacccatcgagggtctacgagtcctagtaagtattttgacgtactttactagtttacggtactaaacgtagttaaccgtttaccccgttcccgtaccccccgggtacgtttcccggtaaccgaacggggtaaccgtaacgggtacggtaaacgtaacgaaacggcggtaaaccgttggtacggtcgttacggccttaaccctaattccgttgttacccttcttacttccccttccccgtaaccc

SEQ ID NO: 364911 - DNA, 672 bp, Homo sapiens
  misc_feature: GZ8MTXP01C3AZ9.13.53.E09.1.454.CMB.2.raw
  modified_base (377)..(377): a, c, t, g, unknown or other
  modified_base (404)..(404): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtccaccatcacttgtcgggacaagtcaagaactattggactaaacttactttaaattggtatcagcaagaagtcgagggcaacgccccgaactcctagactctacgtacatccctattcgacacgaggtggactcccccatacgtaaggttcaggtaggactaaggtanactcgtaagaactagttactttacccnctactataccggtagggtacctaacgacgtaccgttagtaacgttacgttttacgaccgttaactttaacgttagtttacggtaacctaaactacgttaaccgtttaaccccgttccccggttacccccggtaaccggtttccgggaacccggtaaacggggtaacccgtaagggtaacggtaaacttacgtaaacggacgtaaacgtcggttaacgggcttacggaactaccgtaattccgtacgttcttccgttaaccgtttcccg

SEQ ID NO: 364912 - DNA, 561 bp, Homo sapiens
  misc_feature: GZ8MTXP01DWYAV.13.53.E09.1.454.CMB.2.raw
  modified_base (347)..(347): a, c, t, g, unknown or other
  modified_base (374)..(374): a, c, t, g, unknown or other
  modified_base (534)..(534): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagaacattggcaacttctttaaatggtatcagcaagaagtcagggacaagccccgaacctctgatctacgtacatccactttgcacagtggactcccccatcaaggttcagtgcngtagatctaggaacagtactttacccncactatcgagggtctacgagtcctagaagtatttgacgtacttactattagtacaaactagtacttacccttccgtaccccggtacgttccggaccgtaacggaccgaaggtaacggtaaacacgtaacgacgtaacgtgttcggttcgttacgaacacncgttactcgttcttcttaacgttcccg

SEQ ID NO: 364913 - DNA, 737 bp, Homo sapiens
  misc_feature: GZ8MTXP01AYQI0.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttgtcgggcaagtcagaacattggctaactctttaaattggtatcagcagaagtcgagggacaacggccccgaacctcctagactccgtaacggtacactcctactttcgacacgaggttcgggaactcccgaattacccgtaaagggtttccgaagggttcgggacctaaaagggttaacgtaacgttaccgttaaaggggtaaaaccctaacgggtttaacctttttaacccccgtacctaaaccctaacgttaccggtaacggggggttaccttaaacggtaccggtacccgttaagggtaaacggtttagtttttcggaaccggttaaccttttaaccggttaattttaccggtaactaaaccgtaacggttaaccgtttaccccgtttcccggttaccccccgggtacggtttacccggtaccggaaacgggtaaccgtaaacgggtaggaaactaaccgtaagacgtaaacgttggtacgcgttcgcgactaatctcgtactcttactcttcccgtc

SEQ ID NO: 364914 - DNA, 517 bp, Homo sapiens
  misc_feature: GZ8MTXP01EJTGP.13.53.E09.1.454.CMB.2.raw
  modified_base (343)..(343): a, c, t, g, unknown or other
  modified_base (366)..(366): a, c, t, g, unknown or other
  modified_base (496)..(496): a, c, t, g, unknown or other
tcagtcacgtactacacgaccggtgctcgatttagagagagtgtgttgggtttgggggagcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaatcttaaatggtatcagcagagtcagggcaacgccccgaactcctgactctacgtacactcctactttgcacagtggactccatccaaggttcagtgcaagtantctaggaaacagtactttacccnaccatcgagggtctacagctagaagtatttgactacttactattcgtacaactagtacgttaccttcgtccccggagttcgacgaaggtaccgaagtcggaaatcaagcgagttaggtcgtcgcgcactntctctctcttctccttccgtc

SEQ ID NO: 364915 - DNA, 623 bp, Homo sapiens
  misc_feature: GZ8MTXP01DAZWG.13.53.E09.1.454.CMB.2.raw
  modified_base (202)..(202): a, c, t, g, unknown or other
  modified_base (479)..(479): a, c, t, g, unknown or other
  modified_base (623)..(623): a, c, t, g, unknown or other
tcagtcacgtactacacgaccggtgctcgatttagagagagtgtgttgggtttgggggcaggagtcagtctcagtcaggacacagcatggacatgagggtccccgctcagctccgtggggctcctgctgctctggctcccaggtgccagatgtgacatccagttgacccagtctccatccttcctgtctgcatctgtagganacagatcaccatcacttgccgggcagtcaggactattaactagttattagtctaggtatacaagaacaaaaaaccgagggaaactacctaagctcctagattctattgttgactacttacctacgttttagacgtaaagggttcggggtacccctaagtaccgtaaaggttcgaaggccggaacgtaggttcgggacttacgggttacggggaactaaggtaacttcctactactacaactaatacacgacacggtcctgacacgcctagaaagttnttttacggactttaaacttattactagtaacaacgttataacttaattaccgttacccgtcttcggtaacggtttcgggacgggtaacgggaccgtaagggtagagttacttacgaaacgtacgtggacgcttacgcaaccgtn

SEQ ID NO: 364916 - DNA, 555 bp, Homo sapiens
  misc_feature: GZ8MTXP01AJZ2T.13.53.E09.1.454.CMB.2.raw
  modified_base (223)..(223): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctcccaggtgccagatgtgccatccagatgacccagtctccatcctccctgtctgcatctgtaggagacagagtcaccatcacttggccgggnaagtcagggcattagaaatgtattaggctggatcagacaagaaaccgagggaaacgcccctaagctcttgatctagtggtgctattaccgtaaaggttttaaaaaggtcgggggtacccagtacgtaacggttcaggcggcaggtggatcgtgggcacagtacttcattctacacatcagcagcctgcagccgtagaagttattttagacttaactttattactgtactaacagtatacaactaattactccgtgggtaacgtcggaccgaagggaccgaagggtagaaacgttacaaacggtaactaggtcggctgacctaacgttgttcg

SEQ ID NO: 364917 - DNA, 579 bp, Homo sapiens
  misc_feature: GZ8MTXP01A0DW1.13.53.E09.1.454.CMB.2.raw
  modified_base (348)..(348): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaactcctgactctacggtacatccactttgcacagtcggactcccatccaggttcagtgcaagtagntcgtaggaacagtactttacccncaccatcgagggtctacagcctagaagtatttagacgtacttactattcgtacaacgtacgtaaccgtttacccttccgtacccccggtacgttccggaccgtaacggtaccggtaacgtaacgggaagtaacgtaacgacggtacgttacgtacggtcgcgttcgaccgaactacgtcgttcttcttactaaccgttcccgtccccg

SEQ ID NO: 364918 - DNA, 543 bp, Homo sapiens
  misc_feature: GZ8MTXP01C1TNB.13.53.E09.1.454.CMB.2.raw
  modified_base (288)..(288): a, c, t, g, unknown or other
  modified_base (345)..(345): a, c, t, g, unknown or other
  modified_base (369)..(369): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaacgccccgaacctccngatctacggtacatccactttgcacagtggatcccatccaaggttcagtgcaagtantctgggaactagtacttttacccnaccatcgagggtctacagacctagaagtattttcgacgtacttactaattgtactaaactagtacgttacccgttcctcccccggtacgttccggaccgaacggaaccgaaggtaggaaagtaacaagcgaacgttgtaggcttcgcacaatctctcttcattccttcccgtcc

SEQ ID NO: 364919 - DNA, 541 bp, Homo sapiens
  misc_feature: GZ8MTXP01DMUK8.13.53.E09.1.454.CMB.2.raw
  modified_base (346)..(346): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaactcctgatctacggtacatccactttgcacagtggatcccatccaaggttcagtgcaagtagntctaggaaactagtacttttaccctcacccatcgagggtctacgagtcctagaagtattttgacgtacttactattgtacaactagtacgtttaccttccgtccccggtacgttccggaccgaacgggtaccgaaaggtcgggaaatcgaaagacgaacttgtacggcttgcacaatctgtctcactcttccgcc

SEQ ID NO: 364920 - DNA, 549 bp, Homo sapiens
  misc_feature: GZ8MTXP01BW228.13.53.E09.1.454.CMB.2.raw
  modified_base (345)..(345): a, c, t, g, unknown or other
  modified_base (369)..(369): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaagccccgaactcctgatctacgtacatccactttgcacagtggatcccatccaaggttcagtgcaagtagntctaggaacagtacttttacccanacccatcgaggggtctacgacgtcctagaagtattttgacgtacttatattgtacaaactagtacttaccttcctccccggacgttcggaccgaacggtaccgaaaggtaggaaactaacgaacgacgtaaacgttgtaggtcttcgcaccaatctcgttctcacttccttcccgtaacc

SEQ ID NO: 364921 - DNA, 610 bp, Homo sapiens
  misc_feature: GZ8MTXP01B1E5B.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacgttgtcgggacaagtcaagaactagttggactaacttactttaaatggtatcagtcaagaagtcgagggcaacgaccccgaactcctagactacgtaacggtactactaccctatttcgacaacgtaggtcggactaccccccatacgtaaggttcaggtgacaagtagatcgtagaactagtactttacccacactagtcgagggtacacgacgtcgtagaagtattacgacgtaacttactattacgtactaactacgtacgttaccttcccgtccccggtacgttccgaccggaacgggtaccgaaggtaacggaaacgttacgtaaacgacgtaacgtacggttacggcgttacgtaacacctaacgtctacgttcttcttaacttcccg

SEQ ID NO: 364922 - DNA, 738 bp, Homo sapiens
  misc_feature: GZ8MTXP01EPWXD.13.53.E09.1.454.CMB.2.raw
  modified_base (197)..(197): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacgagggtcaccatcacttgtcggcaagtcagaacattggacaacttactttaaatggtatcagcagaagtcgagggcaacgccccgaactcctgactcgtacggtacactcctaactttgcacgtagtcggactcccataccccgaaaggtttcaggtcggacaaaggttagaacgttcgtagggaaactacgttaacctttttaccccactaaccctagtaccggtaacggggtttctaacgacgtacccgttaaggtaaacgtttagttttacggaacgttaacccgtttaacgttaatttacggtaacctaaacgttaacggggttaaaccgtttttaaacccctttcccgtaaccccgtaccgggttaaccggtttaccgggtaacccggaaaccggggtaaacccgtaaaggggtaacgggtaaaacttaacccgaaaggaccggttaaaccgtgggtttaacgggccttacggaccgtaaccccgtaattccggtttaacgtcgtttacctaaccgttttaacccgttcccccg

SEQ ID NO: 364923 - DNA, 696 bp, Homo sapiens
  misc_feature: GZ8MTXP01AMYAY.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcaccatcacgttgtcgggcaagtcaagaacagttggactaacttctttaaagttggtaatcgagtacaagtaaggtcgaagggaccaaccggcccccgtaaacctcccgtaggtaacttaccgttaacggtacctacttccctaacttttggacctaacgagggttacgggaccttaccccccgaattacgtaaagggtttccaaggttacgggactaaggtagtacgtacgtacggggaaactacggttaaccttttaccccgtactacccgtagtaccggtacggggtacctaacgtacggtacctaggtaaacgttacgtttacgacgttactttaactaggtttacggtaactaaacgtacggttacctttacccgtccgtaccccggtagttccggaccgaacggacgaaggtaagtaagacgaacgcgaacgtgcgttcgttagcctacgtaacttcgtcgttacctcttaaccgttcccg

SEQ ID NO: 364924 - DNA, 620 bp, Homo sapiens
  misc_feature: GZ8MTXP01A2N4S.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacaggtcacatcacttgtcggcaagtcagacattggacaacttcttaaatggtatcagcagagtcagggcaacgccccgaactcctagactcgtacggtacagtcctactttgcacgagtcggactcccagtcccaaggttcaggtggactaaaggtaagtctacgtacggaaactacggttaactttttaccccactacctacgttcgaacgggggttactaacgacggtaccttaggtaaagttacgttttacggtacgttaacgtttaacttagtttacggtaactaaacgtaagttaaccgtttacccttacccgtcccccggtacgttccggaaccgtaacgggaaccgtaaggtacgtaataacgaagacgacgttgtacggcttcgcacaatcgtctctcttactccgttccgtcc

SEQ ID NO: 364925 - DNA, 697 bp, Homo sapiens
  misc_feature: GZ8MTXP01C71R1.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtccaccatcacttgtcggcaagtcaagacattggactaacttactttaaattggtatcagacagaagtcgagggacaacgccccgaacctcctgactctacggtacatccctatttcgacacgtaggtacggactcccattaccgtaaggttcaggttcgacgtaaagtagaactacgtagggaaactaggttaacccttttacccctacgtaaccctagttacggtaacgggggttacctaacgaccgtacccgtaaggtaaagttatttttacggaccgttaactttacgttaagtttacggtaactaaacgtacgggttaacccgtttacccgtttaccccggtaccccccgggtacggtttacccgggaacccggtaaaccggggaacccgtaaacggggtaacggaaacgttaaccgaaggaccgtaaacgttggttaacggcttacggccacctaatcgtcttcctcttacttccgttcccgtaacc

SEQ ID NO: 364926 - DNA, 575 bp, Homo sapiens
  misc_feature: GZ8MTXP01BEPMT.13.53.E09.1.454.CMB.2.raw
  modified_base (358)..(358): a, c, t, g, unknown or other
  modified_base (384)..(384): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacagggtcaccatcacttggtcggcaagtcaagaacagttggacaacttactttaaattggtatcagcagaagtcagggcaacgccccgaactcctgactctacgtacatcatttgctacagtggactcccataccgaaggttcaggtgctaagtacgntacgtaggtaactagtactttacccnctacctatcgagggtctacagtcctagtaagtatttcgactacttactattacgtacaaacgtagttacgttacccttccgtacccccgtacgtccggtacgaacgggtaccgaaggtacggaaataacgaagacgtaacgttcgtgggtcttgcaccaatcgtgttcttcttaccttcttaaccccgtcc

SEQ ID NO: 364927 - DNA, 557 bp, Homo sapiens
  misc_feature: GZ8MTXP01A69ZX.13.53.E09.1.454.CMB.2.raw
  modified_base (408)..(408): a, c, t, g, unknown or other
  modified_base (537)..(537): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactcttaatggtatcagcagagtcagggcaacgccccgaacctcctgactctacggtacatcctactttgcacagtcgggatcccatccaaggttcagtggcaagtagaatcgtagggaaactacgtacttttacccactaccatacgacggggtctacagcctagaagtnttttacgcgtacttactattcgtacaaactacgtacgttacccttccgtcccccggtacgtttccgaccgaaacgggtaccgaaaggttaggaaactaacgaagcgaaacttgtggacttcgcacaatntctctcttactcttccccgc

SEQ ID NO: 364928 - DNA, 608 bp, Homo sapiens
  misc_feature: GZ8MTXP01E1ORU.13.53.E09.1.454.CMB.2.raw
  modified_base (562)..(562): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtcaccatcacttgtcggcaagtcaagaacattggacaactactttaaattggtatcagcagagtcagggcaacgccccgaactctgactctacggtacactcctactttcgacacgaggtcgggactcccataccgtaaggttcaagtggactaagtagctcgtaggaaactagtacttttaccccactaaccgatacgaggggtacctacgacgtcccgttaagaacgtttagtttcggacgtacttaacttattacgtacgtaaactacggtacgtttacccttccgtccccggtacgtacggacgaacgggtacgaacggtacgaagtaacgaacgacgtacttaggtcgtacgngttccacctaactcttcgttccttattcccttccgttaaccgtaac

SEQ ID NO: 364929 - DNA, 568 bp, Homo sapiens
  misc_feature: GZ8MTXP01CEFBF.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaacttctttaaatggtatcagcaagaagtcagggcaacgccccgaactcctgactctacgtacatccatttgacacagtcggactcccccatacgaaggttcagtggacaagtagatcgtaggaactagtacttttacccacacctagtcgacgggtctacgagtcctagaagtatttgacgtacttactagttcgtacaactacgtacttaccctccgtaccccggtagttccgaccgaaacgggccgaaaggtaacgaaattcgaaagcgtaaactggttacggcttacggcacctaattcctgttacttcgaacgtttccc

SEQ ID NO: 364930 - DNA, 597 bp, Homo sapiens
  misc_feature: GZ8MTXP01DM8HQ.13.53.E09.1.454.CMB.2.raw
  modified_base (297)..(297): a, c, t, g, unknown or other
  modified_base (385)..(385): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtcttcgtctctcggagacagggtcaccatcacttgtcgggcaagtcagaacattggactaacttactttaaattggtatcagcagaagtcgaggacaacgccccaactcctnatactacgtacactcctactttcgcacagtggactcccataccgtaagtcagtggacagtaacgatcgtagaactacgtactttaccncacatacgacgggtacacgagacctagtaagttagttacgacgttaacttacttacttacgtactaacgtacgttacgttacccttcccgtaccccggtacggtaccggtaccgtaaacggtacggaaacggtaggtaaactacgaacggtacgaaacgtcgtggttcgttcgaccaacgtactcgttctcttactccttcccgttaacccg

SEQ ID NO: 364931 - DNA, 698 bp, Homo sapiens
  misc_feature: GZ8MTXP01CECUZ.13.53.E09.1.454.CMB.2.raw
tcagtcacgtactacacgaccggtgctcgatttagagagagtgtgttgggtttgggggagtcagtctcagtcaggacacagcatggacatggagggtccccgctcagctccgtggggctcctgctactctggctccgaggtgccagatgtgacatccagatgagccagtctccatccaccctgtctgcgtctcgtcggagacgagggtccaaccatctacgttgtcgggacaagtcaagaacagttcggactaacttactttaaattggtatcagacagaagtcgagggacaaccgccccgaacctcctagtactcgtacggtacactcctatttcgacacgtagtcggactcccagtacccgaaggttcaggtcggactaaagtagctcgtacgaaacttacgtaacctttacccacacccgtagtaccggtagggttacctacgacgtaccgttaaggtaaagtttacgttttacgacgttaacctttaacttagtttacggttaacaaaacgttacggttaaccttttaccccgttacccggttaccccccgggtacgtttaccgggaaccccgaaacggggtaacccgtaaaggggttaacgaaacgttaacgaaacgccggtaaacgttggtcgggtcttacggccaccgttaatccgttcgtttctaccgttacttccccttaacccggtcc

SEQ ID NO: 364932 - DNA, 573 bp, Homo sapiens
  misc_feature: GZ8MTXP01DMSCB.13.53.E09.1.454.CMB.2.raw
  modified_base (290)..(290): a, c, t, g, unknown or other
  modified_base (350)..(350): a, c, t, g, unknown or other
  modified_base (534)..(534): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaacctccngatctacggtacatccactttgcacgagtggatcccatccaaggttcagtggcaagtagntcgtaggaaactagtacttttacccacaccatcgaggggtactacgagtcctagtaagtatttgacgtacttaactatttgtactaacgtaacgttaccgtttacccgttacccgtcccccggtacggtttccggacccgtaaagggacccgaaagggtacggaaataacgaagcgaacgttgnggtcttgccactaatctgttctcttactccgttccgtcc

SEQ ID NO: 364933 - DNA, 567 bp, Homo sapiens
  misc_feature: GZ8MTXP01AXI73.13.53.E09.1.454.CMB.2.raw
  modified_base (226)..(226): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggnaagtcagaacattggcaactctttaaatggtatcagcagaagtcaggcaagccccgaacctcctgatctacggtacatccactttgcacagtggactcccccatcaagttcagtggcaagtagatcgtggaacagtactttacccacacctagtcgaggggtctacgacgcctagaagtatttgacgtacttactagttacgtacaacgtacgtacgtttaaccctccgtacccccggtacgttccggtaccgaaacgggtaccgaagggtaacggaaattacgaagttacgaaacgtggttcggcttcgaacaccaatctacgttctcgttaacttcccg

SEQ ID NO: 364934 - DNA, 551 bp, Homo sapiens
  misc_feature: GZ8MTXP01AEWFK.13.53.E09.1.454.CMB.2.raw
  modified_base (376)..(376): a, c, t, g, unknown or other
  modified_base (410)..(410): a, c, t, g, unknown or other
  modified_base (528)..(528): a, c, t, g, unknown or other
tcagtcacgtactacacgaccggtgctcgatttagagagagtgtgttgggtttgggggagtcagtctcagtcaggacacagcatggacatgagggtcccgctcagctcctggggctcctgctactctggctccgaggtgccagatgtgacatccagatgagccagtctccatcccaccctgtctgcgtctctcggagacagggtcaccatcacttgtcgggcaagtcagaacattggcaactctttaaattggtatcagcagaagtcagggcaacgccccgaactctgactctacggtacatccactttgcacagtgggactccatccaaggttcaggtggcaagtagaatcgtagggaactagtacttttacccncaaccatcgaggggtctaacgacgcccgaaagtntttgacgtacttactattgtacaaacgtagtacgttaccttccgtccccggagttccgaccgaacgggacctaagggtagaaactcgaagtcgaacgtgttggctcgccacactcgtntcttctacttcttcccgctaacg

SEQ ID NO: 364935 - DNA, 626 bp, Homo sapiens
  misc_feature: GZ8MTXP01A0M1W.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcggcaagtcagaacattggactaacttctttaaagttggtatcagacagaagtcgagggcaacgccccgaactcctgactctacggtacactcctactttgacacgaggtggactccgataccgtaaggttcaggtcggactaaggtagaacgtcgtagggaaactacgttaacttttaccccgataaccctagtacgacggggttacctaacgacgtccgttagtaaagttattttcgaccgttacttaactagtttcgtacaacgtacgtaccgtttacccttccgtaccccggtacgtcggtaccggaacggtaaccgtaaggtacggaaagtaacgaacgttacggtacgttagtggcttacgccactaacgtctcgttcttcttacttccgttcccgtaaccc

SEQ ID NO: 364936 - DNA, 584 bp, Homo sapiens
  misc_feature: GZ8MTXP01EGVWU.13.53.E09.1.454.CMB.2.raw
  modified_base (296)..(296): a, c, t, g, unknown or other
  modified_base (356)..(356): a, c, t, g, unknown or other
  modified_base (381)..(381): a, c, t, g, unknown or other
  modified_base (404)..(404): a, c, t, g, unknown or other
  modified_base (416)..(416): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaaccatcacgttgtcgggcaaagtcaagaacattggacaaacttctttaaattggtatcagcagaagtcagggcaacgccccgaactccngactcgtacggtacatccactttcgcacagttggactccataccagttcagtgcaagtantcgtaaggactagtacttttacccnctacccatcgtagggtctacganccttaggaaatntttcggacttaaccttattaattcgtacgaaacttaggtacctttacccgttccgtcccccggtagtaccggtaccggaacggtaacccgtaggtaggaaactaacgaagacgtaacgttgtcggcttcggcacctaagtcttcttctacttcctcgttccccgtaac

SEQ ID NO: 364937 - DNA, 615 bp, Homo sapiens
  misc_feature: GZ8MTXP01API94.13.53.E09.1.454.CMB.2.raw
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggcaactctttaaattggtatcagcagaagtcagggcaagccccgaactcctgactctacggtacatccatttgcacagtggatcccatccaaggttcaagtggcaagtagaatcgtagggaactagtacttttacccgacacccatcgaggggtctacgacgtcctagaacgtattttcgcgtactttacgtattcggtactaaacagtacgtttaccccgttccgtccccccggtagtttccggaccgtaaacggacccggtaaaggtacggaaactaacgtaaacgacggaaaccgttgttacgggcttacggttccaacccgtaattaccgtcggttaaccttcgttaccgttaacccttttccccggtaaccccg

SEQ ID NO: 364938 - DNA, 875 bp, Homo sapiens
  misc_feature: GZ8MTXP01CPOMJ.13.53.E09.1.454.CMB.2.raw
tcagtcacgtactacacgaccggtgctcgatttagagagagtgtgttgggtttgggggagtacagtctcagtcaggacacagcatggacatgagggtccccgctcagctcctggggctcctgctactctggctccgaggtgccagatgtgacatccagatgagccagtctccatccaccctgtctgcgtctctcggagacagggtccaccatcacgttggtcgggacaaagtccaagaactagttcgggactaacttacgttttaaaagttgggtaactcaggcaaggtaagtcgaacggggtacaaaccggcccccgtaaactccgtagactcgtaccggtactacgtacctaactttgacctacgtaggttacggggaacttccccaagtacccgtaaacgggttacaggttacggacgtaaacgttaacgaacgttacgtaagggtaaaccgtaacgttaaaccctttttaaccccaccgtaaacccctaagtttacccggtaaacggggggttaccttaaaccggtaccggtaaccccgttaaggtaaacgtttacgttttttacggaccgttaaaccgtttaacctttaagtttaccggttaacctaaaccggtttaacggttaacccgtttaaccccggtttccccggttaaccccccggggtaccggtttacccgggtaaaccccggtaaacgggggtaaaccccgtaaaaggggttacgggtaaaacgttcccgggaaaaaggccgggttaaaacgttcggggttaacggggtacccgttaacgggttccccgttaaaccctaacgtttcccgttaacgttttacccggttcccttaccgttaaccccgtttcccccggttaacccg

SEQ ID NO: 364939 - DNA, 555 bp, Homo sapiens
  misc_feature: GZ8MTXP01ACBYS.13.53.E09.1.454.CMB.2.raw
  modified_base (347)..(347): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaactcctgatctacggtacatccactttgcacagtggactcccatccaaggttcagtggcaagtantctaggaactagtacttttacccncaccatcgaggggtctacgagcctagaagtattttgacgtacttactattgtacaactagtacgttacccttccgtccccggacgttccgaccgaacgggacccgtaaggtacggaaagtaacgaagacgtaacgttagtggacttcgcactaactctcgttctcttactccgttcccgtaacc

SEQ ID NO: 364940 - DNA, 611 bp, Homo sapiens
  misc_feature: GZ8MTXP01CKCLL.13.53.E09.1.454.CMB.2.raw
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaatggtatcagcagaagtcagggcaacgccccgaacctcctgatctacggtacatcccactttgcacgagtgggactcccatccaaggttcagtggcaagtagaatctagggaactagtacttttaccctcacctatcgaaggggtctacagcctagtaagtattttacggacgtactttaactattagtactaaacgtagtaccgtttaacccttccgttcccccggaacgtttccgggaccgtaaacgggtaacccgtaaaggggtacgaaacgtaacgaaacggttcggaaacgttggttacgggcttacggcccaccaacgttccttcggttccttaccgttacttccctttccccggtccc

SEQ ID NO: 364941 - DNA, 672 bp, Homo sapiens
  misc_feature: GZ8MTXP01C9KY0.13.53.E09.1.454.CMB.2.raw
  modified_base (310)..(310): a, c, t, g, unknown or other
tcagtcacgtactacacgaccggtgctcgatttagagagagtgtgttgggtttgggggcaggagtcagtctcagtcaggacacagcatggacatgacgggtccccgctcagctccgtggggctcctgctactctggctccgaggtgccagatgtgacatccagatgagccagtctccatcccaccctgtctgcgtctcgtcggagacgagggtcaccatctacttggtcgggacaagtcaagaactagttggactaacttactttaaattggtatcagcaagaagtcgagggacaacgccccgaacctcngactctaacgacactcctactttcgcactaggtacggactaccccccagtacgtaaaggttcaaggttcgggactaaggttaagaacttacgtagggtaaactacggtttaacttttacccccactaacctagtaccggacggggtacctaacgacgtcctagtaacgttatttcggacttacttaacttattacgttacaaacgtagttaccgtttacccttcccgtaccccggtacgttaccggtacccaaacgggtacccgaaagggtaaggaaaacgttcgaaacgacggtaaacgtggttacggcgttacggcccaaccgtaactccttcggttccttaacgttaaccgtttccccg

SEQ ID NO: 364942 - DNA, 717 bp, Homo sapiens
  misc_feature: GZ8MTXP01CWQV1.13.53.E09.1.454.CMB.2.raw
  modified_base (222)..(222): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcggnaagtcagaacattggactaacttctttaaattggtatcagcagaagtcgagggccaacgcccccgaacctcccgtagactacgtacggtactactaccttacgtttcgacacgtaggtacggtacctaccctagttacccggtaacggttacgtaggtacggacgtaaacgggtagtaacgtacggtaaacggtaaaccgtaacgtttaacccctttacccctaccaaccgtacgtacgggtacgggttacctacgacgtaccgtaagtaacgtttagtttacgaccgttactttaacttatttacggtaacctaaacggttacgtttacccgtttaccccgttacccggtacccccgggtacggttccggaaaccggtaacgggtaaccgtaagggtaacgtaaacgtaacggaagttaccggtaacgttggtacgggtcttacggccactaacgttcttaacgttccttcttacttccccgttaacccgtaac

SEQ ID NO: 364943 - DNA, 711 bp, Homo sapiens
  misc_feature: GZ8MTXP01DNGTV.13.53.E09.1.454.CMB.2.raw
  modified_base (298)..(298): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacgaggtccaccatcacgttggcggcaagtcaagaactagttggactaacttactttaaagtggtatcagcagaagtcgaggccaacgccccgaacctcngactacgtacgtacacttcctacgtttgactacgtaggtacgggactacccgtatccgtaaacggttcgacggtcgtactaaggtagaacgttacgtaacggtaaactaagttacccttttaacccacgtaaccctagtaccggtagggttaccctagacgtaccgtagtaacgtttatttacggacttactttaacttagttaccgtaacctaacgttaacggttaccctttacccgttaccccgtaccccggtagttacccggaaccgtaaaacgggtcccgtaaagggtacgtaaagtaaccgaaacggttacgtaaacgttcggtaacggtcttacggttccttaaaccgttctaccccggttaagttccctttacccggttactttaacccccggtttcccctaaccg

SEQ ID NO: 364944 - DNA, 672 bp, Homo sapiens
  misc_feature: GZ8MTXP01B1A10.13.53.E09.1.454.CMB.2.raw
  modified_base (672)..(672): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctcactccacctgtctgcgtctcgtcggagacagggtcaccatcacttggtcgggacaagtcaagaactagttcggactaacttactttaaagttggtatcgagacgaagacgtaggacggacacccggaccctacctcgtagtactacgtacgtactactaccttacgttcactacgtaggtacgtacctaccgtacgtacgtacggtacgtaggtacgagtaaagtagtcgtagtaacggtactactttaccctttaccactacctgtacggtacggttacaagtaccgtagtaagttagttacgttcggactttacttagttacgttcgtaacctaaacgttacgtttaaccccgtttacccgttccccggtaccccggttacggtacggtaaaccgggacggtaaaccgggttagaaacgggtacctaaacgagaccgttacggttgcggttcacccgttcacttcttcgtctttaccttgttaccttcccgttcccgtn

SEQ ID NO: 364945 - DNA, 748 bp, Homo sapiens
  misc_feature: GZ8MTXP01DQI44.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccacctgtctgcgtctctcggagacgagggtcaccatcacttgtcgggcaaagtcaagaactagttggactaacttactttaaagttggtaatcgaagtacaaggaagtcgacgggacaacgcccccgaactcctagactcgtaacggtacacgtcctagtttgactacgaggtcggactccctaataccgtaaggttcaggtcgactaaagtagtaacgtacgtaagggaaactaacgttaaccttttaaccccactaaacccgtagttaccggtaacggggttacctaactacggtacccgttaaggtaaagttacgttttacgaaccgttactttaaacgttatttacgtaaaccgtaaacgttaacggttaaccgtttaccccgttacccgttaaccccccgggtacggtttaccgaaacccggtaaacgggtaaacccggtaaacggtaaacggtaaaacgtaacggtaaacggttaaacggtaaccgttaggttacggtcggttacaccggaacccgttaacttcgttaacgtttcccttacgttaccgttccctttccccgtaacccg

SEQ ID NO: 364946 - DNA, 646 bp, Homo sapiens
  misc_feature: GZ8MTXP01D1UHP.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcggcaagtcagaacattggacaactactttaaatggtatcagcagaagtcagggcaacgccccgaactccgtgatactacgtacatccactttgcacgtagtggactcccgataccgtaaaggttcaggttggaccgtaaagtacgaatacgtagggaaacctagtacttttaccccactacccattaccgaggggtaccttacgacgtacgtacgtaagttacttttcgaccgttaacttaacgttaagttacgtaactaaacgtacgttaaccgtttacccgtttcccgacccccgggtacgtttccggaacccggaaacggtaaccgaacgggttaacggaaacgtaacgtaacgacgaaacgttagttcggacgttcgcgttaccaagtactcgtacctcgttcttaaccgttccgttaacccg

SEQ ID NO: 364947 - DNA, 757 bp, Homo sapiens
  misc_feature: GZ8MTXP01DZH4H.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgactatccagatgagccagtctccatccaccctgtctgcgtctcgtcggagacgagggtccaccgagtcacgttggcgggcaagtcagaactattcgactaacttctttaaattcggtatcagacagaagtcgagggcaacgccccgactcagatcgtacggtacagtcctactttgacaacgaggtcggactaccccgaagttacccgtaagggtttcaagggttcggacctaaaagggtacggtaactaccgttaagggaaaccttacggttaaccctttttaaccccactaaaccccgtagtaccggtaacgggggttacctaaacgtaacggtacccgttaaggtaaagtttacgttttacgaaccgttaactttaacgtaacgtttacggtaacctaaacgttacggttaaccggtttaccccgttaccccgttacccccgggaacggtttaccggaacccggtaaacggggtaaccggtaaacggggttagggaaaaccgttaaccggaaaggttaccggtaaaggttcgtaacggggtcttacgttccgttaacctaacgttcttcgggttcctttacgaccgttccgttccccttaacccg

SEQ ID NO: 364948 - DNA, 712 bp, Homo sapiens
  misc_feature: GZ8MTXP01CQ3RG.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacgagggtcaccatcacgttggtcgggacaagtcaagaactagttcggactaacttactttaaattggtatcagcaagaagtcgagggacaaccggccccgaactccgtagactacgtacgtacactcctatttcgacacgtaggtcggtactcccgtaatacccgtaaggtttcgaggttacgggacctaaaaggttaagcgttacggtaacgggtaaacttaacgtttaacctttttaaccccactaacccgtacgtaccggtaacggggttactacgtacgtacccgttagtaaagtttacgtttacgacgttacttacctaagttacgtaactaacgtacgttaaccgtttacccgttacccgtacccccggtacgttaccggaccgtaaacgggaacccgtaaagggtacggaaacgtaacgaaacggttcgtaaacgttcggtcggtcgttcggccttaaccgtaacttccgttcgtacctttcttaccttcccgttaaccccgtccc

SEQ ID NO: 364949 - DNA, 608 bp, Homo sapiens
  misc_feature: GZ8MTXP01BYGFS.13.53.E09.1.454.CMB.2.raw
  modified_base (367)..(367): a, c, t, g, unknown or other
  modified_base (536)..(536): a, c, t, g, unknown or other
  modified_base (552)..(552): a, c, t, g, unknown or other
  modified_base (564)..(564): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacgagggtcaccatcacttgtcggacaagtcagaactgttggactaacttactttaaagttggtatcagacagaagtcgagggacaacgccccgaactccagactctacggtacactcctactttcgcacgagtcggactccagtcctaaggttcagtgacaagtagntcgtagaactacgttacttttacccacaacctagtacgtacgggtactacgacgtactaggtaacgtatttcgacttacttaacgttattacgtacaacgtacgttaccgttacccgttccgtccccggtacgtccggtaccgaacggtaaccggaaaggtacggtaanaacgaacgacgtacgngtcggcgttacnccgttactaacgtctcgtcttccttacttccgttccctaacccg

SEQ ID NO: 364950 - DNA, 737 bp, Homo sapiens
  misc_feature: GZ8MTXP01A311O.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgaggtcaccatcacttgtcggacaagtcagaactattggactaacttctttaaaagttggtatcgagacaagaacgtcgaagggcaaacgccccgaacctcctagactactacggtacacgtcctacgtttcgacacgtaggtcggactccgataccgaaggttcaggtcgcaaagtagaacgtacgtacgggaaactacggttacttttaccccgactaacccgtatccggtaacggggttctaacgacgtaccttaaggtaaacgttacgttttacggaccgttaaactttaacgttaacgtttacggtaacctaaacgtacggtttaaaccgtttaaccccgtttaccccggtaaccccccgggtacggttacccggtaacccggtaaaccgggtaaaccggtaaacgggttaacgggaaaccgtaacgtaaacgggaccgtaacgttacgggtacggtaccggttacggcccttaacgtaaccggttcctttcggttacccttacgttaccctttcccgttccccggttaaccg

SEQ ID NO: 364951 - DNA, 573 bp, Homo sapiens
  misc_feature: GZ8MTXP01E2ZE7.13.53.E09.1.454.CMB.2.raw
  modified_base (542)..(542): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggcaagccccgaaacctcctgatctacggtacatccctactttgcacaggtgggactcccccatactaaggttcagtgcaagtagatcgtggaactagtacttttaccctacaccagtcgacggggtcacgtacgcctagaagtatttgcgtacttactattgtacaacagtacgttccttcccgtaccccggtacgtccggtaccgaacggaacgaacgggtaaggaacgttacgaaacgacgaacgtcggttcggcgttcggctaccncgttactcgttcttccgttaacgtttccccg

SEQ ID NO: 364952 - DNA, 683 bp, Homo sapiens
  misc_feature: GZ8MTXP01AGC6R.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacgttgtcgggcaagtcagaacattggacaacttctttaaattggtatcagcagaagtcagggcaagccccaactctgatctacgtacatcctatttgacacgaggtggactcccataccgaaggtcaagtggacaaagtagctcgtagggaaactacggtactttttacccactaaacccagttacgtaacgggggttaccttacgaggtacccttaaggtaaagtttacgttttacgacgttaaactttaaccttaatttaccggttaactaaaccgttaacggttaaccgttttaaacccccgtttcccggttacccccccgggtacggtttacccgggaacccggtaaacgggaacccggtaaagggttaacgggaaacgttaacgaaaccggttacggtaaaccgttcggtacggtcttcggttacacctaacgttctcgttctccttactccctttccccgtaacc

SEQ ID NO: 364953 - DNA, 605 bp, Homo sapiens
  misc_feature: GZ8MTXP01BPYR9.13.53.E09.1.454.CMB.2.raw
  modified_base (232)..(232): a, c, t, g, unknown or other
  modified_base (354)..(354): a, c, t, g, unknown or other
  modified_base (380)..(380): a, c, t, g, unknown or other
  modified_base (580)..(580): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacnttgacaactcttaaatggtatcagcagagtcagggcaacgccccgaactcctagactctacgtacatcctactttgactacgagttggactacccatacccaaggttcagtcgcaaagtagntctagggaaacagtaacttttacccnctaaccctataccgaggggtactaacgagtacccgtaagtaaacgttattttacgggacgttaacctttaataagttcgttacgaaaactacggttaacctttaacccgttcccgttaccccggaacgttcgtaccgaaacgggaaccgtaaaggtacgaaacgaactaaacgcgtaacgttagtcgggacttgcacctntcgtctctcttactccgttcccgtc

SEQ ID NO: 364954 - DNA, 568 bp, Homo sapiens
  misc_feature: GZ8MTXP01CK2ZR.13.53.E09.1.454.CMB.2.raw
  modified_base (220)..(220): a, c, t, g, unknown or other
  modified_base (283)..(283): a, c, t, g, unknown or other
  modified_base (359)..(359): a, c, t, g, unknown or other
  modified_base (387)..(387): a, c, t, g, unknown or other
  modified_base (552)..(552): a, c, t, g, unknown or other
tcagtcacgtactacacgaccggtgctcgatttagagagagtgtgttgggtttggggagtcagtctcagtcaggacacagcatggacatgacgggtccccgctcagctcctggggctcctgctactctggctccgaggtgccagatgtgacatccagatgagccagtctccatccaccctgtctgcgtctctcggagacagggtcacatcagttgtcggnaagtcaagaacattggactaactctttaaagtgtatcagcagagtcagggcaacgcccactcngactctacgtactactcctatttgctactagtcgggactcccagtacccgtaaggttcaggttcgactaagtacgntcgtaggaaactacgtaactttaccccncaaccatacgtagggtacctagacgtaccgtagtaacgtatttcggactacttactattacgtactaactaggtacttaccctccgtcccgacgttcgaaccgtaggaccaaggtacgaaatcaaggcgtaacgttcgtacggcgttcgcgactaatcgtctctnttactccttccgaacc

SEQ ID NO: 364955 - DNA, 578 bp, Homo sapiens
  misc_feature: GZ8MTXP01CKOQ3.13.53.E09.1.454.CMB.2.raw
  modified_base (296)..(296): a, c, t, g, unknown or other
  modified_base (358)..(358): a, c, t, g, unknown or other
  modified_base (385)..(385): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtcacatcacttggtcggacaagtcaagaacagttcggactaacttcttttaaatggtatcagcagaagtcgagggcaacgccccgaactcngactcacgtacactcctactttgcacgagtggactcccatccgaaggttcaggtgcaagtantcgtaggaactagtacttttacccganacctatcgacgggtctacgacgtacctagtaagtatttggacttacttactattcgtacaactagtaccgttacctccgtccccggagttacggaccgaacgggtaacctaagggtacgaaactaacgaacgttacgtacgttggtacgcttcggcaccgtaattctcgttcttcttactccttcccgtaacc

SEQ ID NO: 364956 - DNA, 705 bp, Homo sapiens
  misc_feature: GZ8MTXP01A19BU.13.53.E09.1.454.CMB.2.raw
  modified_base (226)..(226): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtcaccatcacgttggtcggganaagtcaagaactagttggactaacttactttaaagttggtaatcagacaaggaacgtcgaaggggaccaaccggacccccgaacctcctagtactcctaacggtacactccctatttcgacacgaggtacggactcccagtaccgaaggtttcaggtggactaaagtacgaatcgtaaggtaaactacgttaaccttttaccccactaaccctacgtacggtacggggtactacgacgtccgttaagtaagttacgtttacgaccgttacttaacttagttacgtaacctaacgtacggtaccgtttaccccttcccggtacccccggtacggttaccggaccggtaacggggtaaaccgaaacggggtaacggtaaacgtaaacggaacggttacggtaacgttcggtacggtacgttcgttaccgaccgtaattcctttcgttccttcgttacctttaacccgttccccgttaaccg

SEQ ID NO: 364957 - DNA, 723 bp, Homo sapiens
  misc_feature: GZ8MTXP01APXA9.13.53.E09.1.454.CMB.2.raw
  modified_base (667)..(667): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacgaggtcaccatcacttggtcggacaagtcaagaactagttggactaacttctttaaagttggtatcagcaagtaacgtcgagggacaaccgaccccgaacctctagtaactccgtaacggtacacgtcctacgtttcgacacgtaggtacggtactcccgaagtacccgtaaacggtttcgaaggtcggactaaaaggttaacgcgttacgtaagggaaaccttacgttaaccttttacccacgtaaccctagttccgaacggggttaccacgtaacgtacccgttaaggtaaacgtttacgttttacggaccgtttaaactttaacgttaacgtttacgtaaccgtaaacgtaacggttaccgttttaaccccgttacccggtacccccggttacggtttaccggaacccggtaaacggtaacccggtaaaggttaacgggaaacttaacgaaacgacggtaacgnggtacgtcgttacgcttacctaagtctaacgttctacttacttccgttccgtaacc

SEQ ID NO: 364958 - DNA, 702 bp, Homo sapiens
  misc_feature: GZ8MTXP01A2JAJ.13.53.E09.1.454.CMB.2.raw
  modified_base (103)..(103): a, c, t, g, unknown or other
  modified_base (141)..(141): a, c, t, g, unknown or other
  modified_base (694)..(694): a, c, t, g, unknown or other
tcagtcacgtactacacgaccggtgctcgatttagagagagtgtgttgggttggggcaggagtcagtctcagtcaggacacagcatggacatgaggtccccgntcagctcctggggctcctgctactctggctccgaggtnccagatgtgacatccagatgagccagtctccatccacctgtctgctctcgtcggagacgagggtcacctatccacgttgcgggacaagtcaagtaactagttggactaacttcgttaaagtggatcgagtcaagtacgtcgaggactaacgtccccgtaaactccgtagacttccgttaacgtacactcccgtagtttcgactacgtaggttcggaacctcccccgaagttacggtaaggtttccgaacggttcggtactaaggtacgtaacgttaccgtacgggtaaaccttacgttaaccgttttaccccgacgtaaccgtacggtaccggtaacggggtaccttaacggaccgttaccgtaggtaaacgttacgttacgaccgttacgttaacgtacggtttcgaaccgtaaaccgtacggttaccgttaaccccgtccggtacccgtagtcccgtaaccgtaacggtaccgtaacggtaagtaaccttcgtacggttacgtaacgtcgttacgttcgttacgaacgtctcggtctcgttacttaaccgngttccccg

SEQ ID NO: 364959 - DNA, 717 bp, Homo sapiens
  misc_feature: GZ8MTXP01B6TO2.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggacaagtcagaactagttggactaacttactttaaattggtatcagcaagaagtcagggacaacgcccccgtaactcctagactactacggtactactccctaactttgacacgaggtcggactcccccgtatacgtaacggttcaggtagggactaagttagacgttcgtaacgggtaactacggttacttttacccctaccgtaacctaacgttaccggtaaggggttaccctaacgtacggtacccgttaaggtaaagtttacgttttacggaccgttaaactttaacctttaggtttacggttaaccctaaaccgttaacggttaaccgttttacccccgtttaccccggttacccccggttaacgggtttcccggaacccggtaaacgggaacccgtaaagggttaacggaaacgttaacgtaaccgaggtaaaccgtgttacgttcgacggaaccactaactctcgttacttccgttaacgtttcccg

SEQ ID NO: 364960 - DNA, 669 bp, Homo sapiens
  misc_feature: GZ8MTXP01CM7TR.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtccaccatcacttggtcgggacaagtcaagaacattggactaacttctttaaattggtatcagcaagaagtcgagggacaacgaccccgaacctcctgactcgtacggtacactcctactttgacacgagtcggactcccataccgtaaggttcaggtgactaagtagtaatcgtacggtaaacctagttaacctttacccctacaaccctagttaccggaacggggttacctaacgaacgtacccgttaggtaaacgttacttttacgaaccgttacctttaaacttaagtttacgtaacctaaacgttaacggttaaccgtttacccttacccgtacccgtaaccggttaccggttaccggaccgtaaacgggaaccgtaagggtaagaaactaagaacggtacgaccgtaggtgacgttcgaccgtaactctctcgtcttactaacgttcccgtttaaccccg

SEQ ID NO: 364961 - DNA, 608 bp, Homo sapiens
  misc_feature: GZ8MTXP01D9SAV.13.53.E09.1.454.CMB.2.raw
  modified_base (358)..(358): a, c, t, g, unknown or other
  modified_base (390)..(390): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaactctttaaatggtatcagcagaagtcgagggcaacgccccgaacctcctgactctaacggtactactccctactttgacacgagtggactcccccatacaagttcagtgacngtagtatacgtaggaactacgtactttacccncacctatcgacgggtctacgacgtctagaagtatttgacgtacttacgtattcgtacaactacgtcgttaccctccgtccccggtaacgtcggtaccgaacgggtaaccggaacgggtaacgaaacgttaacgtaaggaaccgtaacgttacggttcggttccgttacggtaacctacctccgttactcggtttacctttccttcgttttaacccccg

SEQ ID NO: 364962 - DNA, 730 bp, Homo sapiens
  misc_feature: GZ8MTXP01CSEDH.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtccaccatctacttggtcgggacaagtcaaggaactattggactaacttactttaaagttggtaatcgaagcaagaacggtacgaggggacaaccggacccccgaaacctccgtagacctacgtaacgtaacctacttaccctactttcgactacgtaacggtcgggacttacccccgatacgtaaaggtttcgaaggtacgggtacaaggtaatacgttaccggtacggtaaactacgttaacctttaccccactaacgtacgtacggtacgggtacctaacgacgtaccgtaaggtaattacgtttcgaacttaacgttacttaaggttacgttaactaaaccgtacgtttaacccgttaccctcccgttaccccgggtacggttacccggtaccgaaaccggggtaacgaaacgggtaacgtaaacgttaccgaaacggacgtaaacggtcgggttacgttcgttaccggaaacctccgtaacttcggttacttaccgttccgttaacccgtttccccg

SEQ ID NO: 364963 - DNA, 623 bp, Homo sapiens
  misc_feature: GZ8MTXP01C1ZRL.13.53.E09.1.454.CMB.2.raw
  modified_base (560)..(560): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtcacatcacttgtcggacaagtcagaacattggacaacttctttaaagttggtatcagcagaagtcgagggcaacgccccgaactcctgactctacggtacatcctactttgcacgtagtcggactcccatacccgtaaggttcgaggtcggactaaaggtagaagttcgtaagggtaaacctagtaacctttacccctacacctacgttacgacggggtactaacgacgtacccgtagtaacgtattttacgacgttacttacgttatttacgtactaaacgtacgttaccgttacccgttcccgtacccccggtacgttccggaccgtaaacggtaccgtaaggtacggtaaanaacgtaagacggtacgttgtacggcttgccttacaatactgtactcacttccttcccgtaacc

SEQ ID NO: 364964 - DNA, 602 bp, Homo sapiens
  misc_feature: GZ8MTXP01BB4S1.13.53.E09.1.454.CMB.2.raw
  modified_base (223)..(223): a, c, t, g, unknown or other
  modified_base (291)..(291): a, c, t, g, unknown or other
  modified_base (351)..(351): a, c, t, g, unknown or other
  modified_base (403)..(403): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggnaagtcagaacattggacaacttctttaaattggtatcagcagaagtcagggcaacgccccgaactccngatctacgtacatccactttgcacagtggactcccatccaaggttcaggtgacaagtagntactagggaacagtactttacccacaccatcgagggtcacgagctagaattntttgtagtactttatatttcgtactaaacgtagttacgtttacccttccgtacccccggtacgtttccggaacccgtaacggggtaacccgtaaagggtacggaaaacgttaaccgaaaggttaccgtaaacgttggtcgggtcttaccggcttaccgtaactcgttcgttccttacgttccttcccttccccgtaacc

SEQ ID NO: 364965 - DNA, 647 bp, Homo sapiens
  misc_feature: GZ8MTXP01CWMXW.13.53.E09.1.454.CMB.2.raw
  modified_base (244)..(244): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtcaccatcacttgtcggcaagtcaagacattggacaactntttaaatggtatcagcagaagtcgaggcaacgccccaactcctgactctacggtacactcctactttcgcacgagtcggactcctataccgaaggttcaggtcgacgaagtacgaatcgtaggaactacgtactttaccctcaccgtatacgtagggtactacgtacgtacctaggtaacgttactttggaaccgttacttaacgttatttcggtactaacgtagttaccgttacccgtttcccgtacccccggtacggtttcggaacccggtaaggggaacccgtaaagggttaccgggaaaagttaaccgaaaacggcgggtaaaccgttgggtaacgggcttaccggcttaaccgtaactcggttaacgttcttacttacgttccctttccccggtaacc

SEQ ID NO: 364966 - DNA, 714 bp, Homo sapiens
  misc_feature: GZ8MTXP01CB3D3.13.53.E09.1.454.CMB.2.raw
  modified_base (350)..(350): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaacttactttaaattggtatcagcagaagtcagggcaacgccccgaactcctagactcacgtacatccactttgcagagtggactccataccaggtcagtgacaagtagntcgtaggaacagtactttaccccacacctagtccgtaaggggttccaacgtacgtcccgttaagtaaacgttagtttttacgaccgttaactttaacttagtttacggtaactaaacgttaacggttaacccgttttaaccccgtttcccgtaccccccggggtaaccgtttccggaacccgggtaaacgggtaaccggtaaacgggtaacggtaaacgttaaccggaaaacggttaccggtaaaccgttacggttacggggtccgttaccggttcccggttaaacccttaaccgttcccgtttaaccggtttcccgttacccgtttaactttaacccccgttttccccccgggttaaaccccg

SEQ ID NO: 364967 - DNA, 685 bp, Homo sapiens
  misc_feature: GZ8MTXP01A4FA1.13.53.E09.1.454.CMB.2.raw
  modified_base (369)..(369): a, c, t, g, unknown or other
  modified_base (395)..(395): a, c, t, g, unknown or other
  modified_base (401)..(401): a, c, t, g, unknown or other
  modified_base (436)..(436): a, c, t, g, unknown or other
tcagtcacgtactacacgaccggtgctcgatttagagagagtgtgttgggtttggggagtcagtctcagtcaggacacagcatggacatgagggtccccgctcagctccgtggggctcctgctactctggctccgaggtgccagatgtgacatccagatgagccagtctccatcccaccctgtctgcgtctcgtcggagacgagggtcaccatcacttggtcggcaagtcaagaactagttggactaacttactttaaatggtatcagcagaagtcgaggcaacgccccgaactcctagactcgtacgtacactcctacttgacacgagtcggactccgatacccgtaaggttcaggtgactaagtagntcgtagggaacctagttactttaccnctactntacggaggtactacgacgtcgttaagtaacggttntttacgaacgttactttaacgttatttacggaactaacgtaacgggttaacctttaccccgtttaccccggtacccccggttacggttacccggtaaacccggggtaaacgggtaaacccgggttaaaccggggtaaaggtaaaccgttaaacgaaacggttaccgggtaaacgttcgggttacggacgttaccggttcacccgtaacttcgttaacgtttcttacttaccgttccctttccgtaaccc

SEQ ID NO: 364968 - DNA, 556 bp, Homo sapiens
  misc_feature: GZ8MTXP01AKBON.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaacttctttaaatggtatcagcagaagtcgagggccaacgccccgaacctcctagactctacgtacatcctactttgacacaggtcggactccccccatcgaaggttcagtcggacaagttagatctaggaacagtactttaccctcacctagtcgagggtctacgacgcctagaagtatttgacgtacttactagttacgtacaacgtagtacgttcctcccgtccccggacgttccggacgacggaccgaaggtaacgaacgatagcgtaacgtgttggcttgaacactaatctcgttcctcttcgtccc

SEQ ID NO: 364969 - DNA, 710 bp, Homo sapiens
  misc_feature: GZ8MTXP01A3TD5.13.53.E09.1.454.CMB.2.raw
  modified_base (665)..(665): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacagggtccacctatcacgttggtcgggacaagtacaagaactagttggactaactttactttaaagttggtaatcgagacaagaagtacgagggaccaacggccccaactccgtgactccgtacgtaacacttcctactttgactacgtaggtcggactccaactacccgtaaggttcgaggtacggacgtaaagggtactaagtcgtaacgggaaactaccgttaccttttaccccgactaccgtacgtcggtaacggggttccttaaacgacgtacccgttaaggtaaccgttttagtttacggaccgttacctttaagttacgtttaaccggtaacgttaaacgtaaccggtttaccgtttaacccccggtttcccgtacccccgggttacggtacccggtaaaccggaccggaaacggtaacggtaagaacgtaacacggttacgaaacgttgcggtacncgttccaactaactgtcttactccttacgttcccttccgtaaccg

SEQ ID NO: 364970 - DNA, 685 bp, Homo sapiens
  misc_feature: GZ8MTXP01BROKF.13.53.E09.1.454.CMB.2.raw
  modified_base (379)..(379): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcacatcacttgtcgggacaagtcagaacagtggactaacttacttaaattggatcagacaagaagtcgaggacaacgaccccgaactcctgactacgtaacgtacactaccctactttgacaacgaggtcggactccccgatacgtaaggttcaggtaggactaaggtanattacgtagaaactacgttaacctttacccacaactacgtacggacgggtctaacgacgtcgtaagtaagttagtttacgacgttaactttacgttagttacggtaactaaactaacggttaccgtttaacccgttcccggtaccccggttaaaccggttccggtaacccgggtaacgggtaaacccggtaaagggtaaacgggtaaacttaacggtaaacggacgtaaaccggtcggttacggttacgttccggaacctaacctaacgttccgtcgtttaccgttaaccgttaacctttcccccg

SEQ ID NO: 364971 - DNA, 747 bp, Homo sapiens
  misc_feature: GZ8MTXP01BRSIV.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtcctccactccaccctgtctgcgtctctcggagacagggtcaccatcacttgtcgggacaagtcagaacattggactaacttcttaaattggatcagcaagagtcgagggcaacgccccgaacctccagactcgtaacggtacactccctactttcgacacagtgggactcccccgatacgtaaggttccaggttacggacgtaaggtacgtaacgttacgtaacgggaaactacggttaaccttttaaccccactaaccctaagtcgaacgggggttacctaacgaacggtacccgttaagtaaacgttacttttacggaacgttaaccgttttaaccttaaggtttacgttaaccgtaaaccgtaacggtttaaccgtttaccccgtttaccccggtacccccgggttaacggtttcccggaaccgggtaaaccgggtaaccggtaaacggggtaaacgggtaaaacgttaccggaaacggttaaccgtaaacggtacggttacgggttcgttaccggtaacccgtaccgtaacgttccttacggttccctttaaccgttaaccttttcccccgg

SEQ ID NO: 364972 - DNA, 570 bp, Homo sapiens
  misc_feature: GZ8MTXP01E0I92.13.53.E09.1.454.CMB.2.raw
  modified_base (351)..(351): a, c, t, g, unknown or other
  modified_base (376)..(376): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaacgccccgaacctctagatctacggtacactccactttgcacaggtggatcccatccaaggttcagtggcaagtagntcgtaggaactagtacttttacccncaccctatacgacggggtctacagccttagaagttatttcgacgtacttactagttcgtactaaacgtagttaccgtttaccttccgtcccccggtacgtttccggaccgtaacgggaaccgaaggtaacggaaagtaacaaagcgaacgttggtcgtcttgcactaatgttctctcttacttccttccgtccc

SEQ ID NO: 364973 - DNA, 664 bp, Homo sapiens
  misc_feature: GZ8MTXP01CIEHV.13.53.E09.1.454.CMB.2.raw
  modified_base (359)..(359): a, c, t, g, unknown or other
  modified_base (381)..(381): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggacaagtcaagaactattggactaacttctttaaattggtatcagcagaagtcagggcaacgccccgaactcctagactcgtacgtacatcctatttgcacgagtcggactccatccaaggttcaggtgacaagtagntctagaactagtactttacccnctaaccctagtacgaggggttacctaacgacgtacccgtaaggtaacgttagttttcgacgttaactttaacgttaatttcggtaacctaaacgtacgttaaccgtttaccccgttacccgttcccccgggtacggtttcccggaaccggtaaacgggtaacccgtaaagggttaacggaaacgttaaccgaaacggaccgtaaaccgttggtacggtcgttaccggccttacccgtaacttcgttcgttaccttcttacgtttccccttccccggttaaccg

SEQ ID NO: 364974 - DNA, 779 bp, Homo sapiens
  misc_feature: GZ8MTXP01D26G7.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacagggtcaccatcacttgtcggacaagtcaagaacattggactaacttactttaaagttggatacagacgaagaagtccgagggaccaacggacccccgtaacctccctagacttaccgtaacggtactacttaccctaactttcgacaacgtaggttcgggaaccttccccccgtaatacgtaaagggtttccaagggttaacgggactaaggtagagttaccgtaggtaaaccgtacgtttaacctttttaaccccacctaaacccgtacgttaccgggtaacggggttaccttaaccggtaacgtcccgttaagtaaagttacgtttacggtaaccgttaaactttaccttaagggtttacgttaacccgtaaacgttaacggttaaccgttttaacccccgttacccgttacccccggtaaaccggttcccggtaaaccgggaaaccgggtaaacccggtaaaggggtaaacggtaaacgttaacggaaacgttaaccgtaaacggttcgttacgggttcttaccgtaaccgtacctaacgttcctcggtttcctcgttaacctttccccg

SEQ ID NO: 364975 - DNA, 677 bp, Homo sapiens
  misc_feature: GZ8MTXP01BKXLA.13.53.E09.1.454.CMB.2.raw
  modified_base (227)..(227): a, c, t, g, unknown or other
  modified_base (410)..(410): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacgagggtccaccatcacttggtcggganaagtcagaacattggactaacttactttaaattggtatcagacagaagtcgagggcaacgccccgaactcctgatctacggtacatcctactttgcacgtaggtacggactcccgtatacccgaaggtttcaggttcggactaaggtagaagtcgtagggaaacctagtaccttttaaccccncgtaacccagttacgaggggtacctacgaacgtccctaggtaaagttacgttttagaccgttaactttaacttagtttacggtactaaacgttggtaaccgtttacccgttcccgtaacccccggtacggttccggtaaccggaacggggtaacccggtaaagggtaaggtaacggttaaccgaaggttaccggtaaaccgttggttaacgggcttcgaccgttacctaattcgtcgttcttcgttacttcccgtttcccgtaaccc

SEQ ID NO: 364976 - DNA, 606 bp, Homo sapiens
  misc_feature: GZ8MTXP01DTXHL.13.53.E09.1.454.CMB.2.raw
  modified_base (199)..(199): a, c, t, g, unknown or other
  modified_base (223)..(223): a, c, t, g, unknown or other
  modified_base (288)..(288): a, c, t, g, unknown or other
  modified_base (364)..(364): a, c, t, g, unknown or other
  modified_base (392)..(392): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgttctctcgganacagggtcaccatcacttgcgganaagtcagaacattggacaacttcttaaatggtatacagcagagtcgaggcaacgccccgactccngactcgtaacgtacaacttcctaactttgacacgaggtcgggactcccataccgaaggttcaggtcgcaaagtacnttacgtaggaaactgttaactttacccncactactacgaggtctacgagtcctagaagttatttgacgtacttacttagttcgtaacaactagtaaccgttaccctcccgtccccggtacgtaccggaaccggtaacggtaacggtaaggtaacggaagtaacgaacgacgtaacgttagtcggtacgttcgttccactaacgtcttaacgttcttccttaacttcccgttcccgttaaccc

SEQ ID NO: 364977 - DNA, 647 bp, Homo sapiens
  misc_feature: GZ8MTXP01EFMYG.13.53.E09.1.454.CMB.2.raw
  modified_base (222)..(222): a, c, t, g, unknown or other
  modified_base (339)..(339): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacgttgtcggnaagtcagaactattggactaactactttaaattggtaatcagcaagaacgtacgaggacaacgccccgaacctcctgactactacggtacactcctactttcgacacgaggtggacnccataccgaaggttcagtgacaaagtagtcgtctacgggaactacgtaacttttaccccgcaaccctagtaccgtaggggttacctacgtacgaccttaagaaagtttagtttacgacgttaacttaacttagttacgtaactaaacgtacgttacccgtttacccgttcccgtaccccgggtacgttccggtaccggtaacgaaaccgtaaggtaacggaaataacgtaacggaacgtacgttacggtggtacttcggcaaacctcgtcgttgtaccttcttaacgttccccgtttcccgtaacccc

SEQ ID NO: 364978 - DNA, 563 bp, Homo sapiens
  misc_feature: GZ8MTXP01ALZE0.13.53.E09.1.454.CMB.2.raw
  modified_base (355)..(355): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttgtcggcaagtcagaacattggactaacttctttaaattggtatcagcagaagtcagggcaacgccccgaacctcctgactctacggtacatcctatttgcacaggtggactcccataccgaggttcaggtgcaagtagntcgtagaaactagtacttttaccccacaacctatcgaggggtcacgagtcctagaagttatttacgccgtattactattgtactaacaagtacgttacccgttccgtccccggacgttcgaccgaacggtacgaaggtacgaataacgaagcgaacttaggtcgacgttcgcgttcaacgtcttcgtcttcactccgttccgtaaccc

SEQ ID NO: 364979 - DNA, 552 bp, Homo sapiens
  misc_feature: GZ8MTXP01AZLUZ.13.53.E09.1.454.CMB.2.raw
  modified_base (279)..(279): a, c, t, g, unknown or other
  modified_base (360)..(360): a, c, t, g, unknown or other
  modified_base (390)..(390): a, c, t, g, unknown or other
tcagtcacgtactacacgaccggtgctcgatttagagagagtgtgttgggtttggggagtcagtctcagtcaggacacagcatggacatgagggtcccgctcagctcctggggctcctgctactctggctccgaggtgccagatgtgacatccagatgagccagtctcatccaccctgtctgcgtctctcggagacagggtcaccatcacttgcggcaagtcagaacattggcactcttaaatggtatcaactagaagtcaggcaagccccgaactccngactctacggtacatccactttgcacgagtggatcccgatcaaggttcagtggcagtaagatcgtagaacagactttaccnaccatccagggtctacagcctaggaaattntttacgacgtacttactattacgtactaagtacgtacgttacctaccgtacccggtacgtccgacggaacggaccgtaggtacgaacgtacgaacgtacgaacgtcggttacgcgtcgacgccgttacgtctacgttcttctacttccggtcccttaacgtc

SEQ ID NO: 364980 - DNA, 563 bp, Homo sapiens
  misc_feature: GZ8MTXP01EUL7U.13.53.E09.1.454.CMB.2.raw
  modified_base (347)..(347): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacagggtcaccatcacttgcggcaagtcaagaacattggacaactctttaaattggtatcagcagaagtcaggcaacgccccgaactcctgatctacggtacatccactttgcacagtggactccatcaaggtcagtggacaagtagntctaggaactagtacttttacccntaccatcgagggtctacagctagaagtatttggactacttactattgtactaactagtaacgttacccttccgtcccccggtagtccgtaccgaacggtaacgaacggtaggaaagtaagaacgacgacgttaggtcgcgttcgttcacctaactacgttcgttcttacttccgttaacccgttccgtaacg

SEQ ID NO: 364981 - DNA, 606 bp, Homo sapiens
  misc_feature: GZ8MTXP01BEMG3.13.53.E09.1.454.CMB.2.raw
  modified_base (313)..(313): a, c, t, g, unknown or other
  modified_base (347)..(347): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttggtcgggcaagtcaagaacattggacaattactttaaattggtatcagcagagtcgaggcaacgccccaactctgatctacgtacatccatttgcanagtggactccatccgaaggttcagtgcaagtagntcgtagggaaactagttaccttttacccactaacctagtacgtaggggtacctacgacgtctacggtaagttagtttcggacttacttaactagtttacgtactaaacgtagtaccgtttaccccttcccgtcccccggtacggttaccggaccgaacgggtaacccgaaggttaacggaagaactaacgacggtaaacgttggtacggtcgttcggccaccgtcttacgtcgttacctcttacttccgttcccgtaac

SEQ ID NO: 364982 - DNA, 607 bp, Homo sapiens
  misc_feature: GZ8MTXP01CS1UR.13.53.E09.1.454.CMB.2.raw
  modified_base (348)..(348): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagaacattggcaactctttaaattggtatcagcagaagtcagggcaacgccccgaacctcctgatctacggtacatccactttgcacagtggatccatcccaaggttcagtgcaagtagntctagggaacagtactttaccctcaacccaatcgaaggggtctaacagccctagaaagtattttcggactaactttaactaagtttcgtactaaactaacggtaacgtttaaccctttcccgtccccccggtaacggtttcggaccccgtaaggggaaccccgtaaaggggtacggtaaaataaccggaaagacggaaacttggtacgggcttacggcacccgaatcccttcgttcttcttacgttccgttcccgtaac

SEQ ID NO: 364983 - DNA, 638 bp, Homo sapiens
  misc_feature: GZ8MTXP01A6TBX.13.53.E09.1.454.CMB.2.raw
  modified_base (281)..(281): a, c, t, g, unknown or other
  modified_base (378)..(378): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagagtcaggcaacgcccgactccngactctacggtacatcctatttcgacacgaggtcggaatcccatacccgaaggttcaagtcggacaagtagaatcgtagaactacgtactttacccncaaccatacgaggggtctacgacgtaccgtagtaaagttagtttcgacgtaacttaacttaagttcggttaactaaacgtaaggtaaccgtttaaccccgttaccgttaccccccggtaacggttcccggtaaccgaacggggtaaaccgtaacgggtaacggaaagtaaccgaaacggacggtaaacgttcggtaggtacgttacgccgacctaacgttccttcggttcttccttaacgttcccttcccgttaaccccg

SEQ ID NO: 364984 - DNA, 557 bp, Homo sapiens
  misc_feature: GZ8MTXP01ABYYJ.13.53.E09.1.454.CMB.2.raw
  modified_base (202)..(202): a, c, t, g, unknown or other
  modified_base (346)..(346): a, c, t, g, unknown or other
  modified_base (368)..(368): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtctgcgtctctcgganacagggtcaccatcacttgtcggcaagtcagacatggcaatcttaaatggatcagcagaagtcagggcaacgccccgaaactcctgactctacggtacactccatttcgcacgagtggactccccatcaaggtcagtgactganatctggaactgtactttacccncacatcgagggttcacgacgcctagaagtatttcggactactttactagttacgtacgtaacgtacgttacgttaccccgttccgtcccccgggtagttccggaccgtaacgggaccgagggttaagaaacgttacgaacgacgtaaacgtcgttggcacgcaacgtctccttcttacctcgttctccg

SEQ ID NO: 364985 - DNA, 796 bp, Homo sapiens
  misc_feature: GZ8MTXP01D8RWE.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttggtcggacaagtcaagaactagttggactaacttactttaaattggtatcagcagaagtcagggcaacgccccgaacctcctagactacgtacgtacactcctactttcgactacgaggttcggactccccgaatacccgtaaggttacgaggttacggacctaaaagggttagtaacgttacgtaacgggtaaacctaacggtttaacctttttaaccccactaaacccgtacgttaccggtaacgggggttacctaacgtaacggtacccgttaaggtaaacggttttacgttttacggtaccgttaactttaactttaaacgtttacggttaaacctaaaacgttaacggttaaaccgttttacccccgtttaccccggttaccccccgggtaaccggtttacccgggtaacccggtaaaccggggtaaacccggtaaacgggtaaaccggtaaacggtaaacggtaaaccggttaaccgggtaaacgttacgggtacggtacgttacgggccttaaccgtaacgttacttccgtttaccgttaccgttaccgttaacccgtttcccccgtaacccg

SEQ ID NO: 364986 - DNA, 567 bp, Homo sapiens
  misc_feature: GZ8MTXP01AX8RM.13.53.E09.1.454.CMB.2.raw
  modified_base (375)..(375): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggctaactcttaaattggtatcagcagaagtcaggcaacgccccgaactcctgactctacggtacatccactttgcacagtcggactcccccatcaaggttcaggtgacaagtagatcaggaacagtactttacccncacatcgacgggtctacagcctagtaagtattgacgtacttatacttcgtactaacgtagtaccgttaccgttcccgtaccccgggtacgttaccggtaccgaacgggtaacccgaaagggtaacggaaacttacgaaacgcgtaacgtagttcggcttcggcaactgtacctgttcttcttaacgttcccg

SEQ ID NO: 364987 - DNA, 670 bp, Homo sapiens
  misc_feature: GZ8MTXP01D4RE1.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttgtcggcaagtcaagaacattggacaacttactttaaattggtatcagcaagaagtcgagggcaacgcccccgaaacctcctagactctaacggtacatcctatttgcacgagtcggactcccatacccgaaggttcaggttcggactaaagtagaacgtcgtaaacgggaaactaacgttaacctttttaccccactaacctagttacgaacggggttactaacacgtacccttaaggtaaagttattttcggacttaactttacttaagtttcgtaacggtaaacacgttaacgtttaaccccgtttccgtaccccccgggtgttaccggtaacccggaacgggtaaaccggaaagggttaacgaaacgtaacgaaacggacgggtaaccttagggtacgtcgttacggcaccctaatctgttcccttcttaccttcccgttcccgtaaccc

SEQ ID NO: 364988 - DNA, 634 bp, Homo sapiens
  misc_feature: GZ8MTXP01BFF1E.13.53.E09.1.454.CMB.2.raw
  modified_base (220)..(220): a, c, t, g, unknown or other
  modified_base (353)..(353): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggnaagtcaagacattgacaattcttaatggtatcagcagagtcgaggcaacgccccgaactctgactctacgtacatcctactttgacacgtaggtcggaactcccataccgaaggttcgagtggcaaagttagntacgtaggaaactagttacctttacccgcactagtcgagggtactacgacgtacgtagaagttatttcgacgtaacttacttagttacgtacgaaactacggtaccgttacccttacccgtacccccggacgtttacccggaccgtaaacgggtaacccgtaagggttacggaaacgtaacgaaacggttacggtaaacgttcggtacggtacgttcgttaccttaccgtaattccgttaacgttaccttccgttaccttcccgtttaaccccgtaacccg

SEQ ID NO: 364989 - DNA, 645 bp, Homo sapiens
  misc_feature: GZ8MTXP01DC1DS.13.53.E09.1.454.CMB.2.raw
  modified_base (363)..(363): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggacaagtcaagaactattggacaacttactttaaattggtatcagcagaagtcgaggcaacgccccgaacctcctgactctacggtacatcctatttcgacacgaggtcggactccataccgaaggttcaggtgcaagtagntacgtaggaaactagtactttacccacaaccatacggagggttctacgacgtacgtagtagttatttcggacttaacttaacgttattacggactaaacgtaggtaaccgtttacccttcccgtacccccggtacgttaccgggacccgtaaaggggaaccctaagggtacgaaacgttaacgaaacgaccggtaaaccgttggtaacggggtcttacggttcccttaacctaacgttccgttcgttcccttacttaccgtttccccttccccggttaaccc

SEQ ID NO: 364990 - DNA, 687 bp, Homo sapiens
  misc_feature: GZ8MTXP01BJ9EM.13.53.E09.1.454.CMB.2.raw
  modified_base (203)..(203): a, c, t, g, unknown or other
tcagtcacgtactacacgaccggtgctcgatttagagagagtgtgttgggtttgggggcaggagtcagtctcagtcaggacacagcatggacatggacgggtccccgctcagctcctggggctcctgctactctggctccgaggtgccagatgtgacatccagatgagccagtctccatccaccctgtctgcgtctctcgganacgagggtcaccatcacgttgtcgggacaagtcaagaactagttggactaacttactttaaaattggaatcgagtcaagaagtcgagggacaacgcccccgaactcctgactctaacggtacatccctatttgcacgaggtggactccccatcgtaaaggttccaagtcggactaagtacgattacgtaggaaactacggttaactttttaccccactaaccgtacttacggtacggggttacctaacgacgtaccgttagtaacgttacgtttacgccgttaaacttacctttagttacggttaccaacgtacgtaccgtttaaccccgttccgtacccccggtaaacggttccggacccggtaaacggtacccggtaaaggtaaccggtaaattacggaaacggttaccgaaacggttcgttacggacggttcgaaccgtaaccgtcttccgtacggttccttaaccttaacggtttccccg

SEQ ID NO: 364991 - DNA, 688 bp, Homo sapiens
  misc_feature: GZ8MTXP01EY87I.13.53.E09.1.454.CMB.2.raw
  modified_base (226)..(226): a, c, t, g, unknown or other
  modified_base (237)..(237): a, c, t, g, unknown or other
  modified_base (370)..(370): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacgagggtcaccatctacgttgtcgggnaagtcagaacntgcaactcttaaatggtatcagcagagtcagggacaacgccccgaaactccatactcgtacgtactactcctacgttcgacacgaggtcggtactacccataccgtaaggttcaaggtcgacgtaaagggtanaacgttacgtaacgaactacgttaccttttaaccactactagtcggtaacgggttcaaacgtacgtccgtaaaggtaactttacgttacggaacttacgttaacttagttacgttaacccggaaagtttaaccgttaccgtttaaaccccgtccccggtaaccccggtcgggttaacccgtaacgggaaacgtaccgggtaaaggtacggtaaacgaacgtaaacggttcgtaaaccgtttggaggttaccacgttaccgacgtaaccgtttactcggttccctaacgttccctttaacccggggttccccttaaccg

SEQ ID NO: 364992 - DNA, 659 bp, Homo sapiens
  misc_feature: GZ8MTXP01AJZNZ.13.53.E09.1.454.CMB.2.raw
  modified_base (349)..(349): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatctacttgtcgggcaagtcaagaactattggactaacttactttaaattggtatcagacaagaagtcgagggacaacgccccgaacctcctagactcgtacgtacatcctactttgcagagtcggatccatcaaggttnagtgcaagtagctacgtaggaaactagtacttttacccactacctagtacgtacggggtctacgagtacccgtagtaagttagtttacgacgttactttactacgttacgtaacgtaaacgtacgttaccgtttaacccgttcccgtaccccggtacgttaccggtaccggtaaacgggtaaccgtaaacgggtaacgtaaacgttaacgaaacggacggtaaacgttcgggtacgggtccgttacggacccgttaccgtaacttcgttccggttacctttaccgttacctttcccttccccgtaacccg

SEQ ID NO: 364993 - DNA, 759 bp, Homo sapiens
  misc_feature: GZ8MTXP01BRH3L.13.53.E09.1.454.CMB.2.raw
  modified_base (222)..(222): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcggnaagtcaagaacattggacaacttcttaaatggtatcagcagaagtcagggccaacgccccgaactcctagactccgtaacggtacactcctactttcgctaacgaggtcggaactccccaagttacccgaagggtttacagggttacggacgtaaaggtaacgtaacgttacgtaaggggtaaaacctaacggttaaccctttttaacccccgacgtaaaccctaacgttaccggtaacgggggttacctaaccgtaacggacccgttaaggtaaacgtttacgtttttacggaccgttaaacctttaacttaaacgtttacggttaaaccaaacgttaacgttaaacccgtttaaccccgtttaccccgtacccccccgggtaacggttaccggttaaaccccgggaaacggtaaacccggtaaacggtaacggtaaacgtaacgaaacggttacgtaaccggttagtaacggtcttacgttaccgaccgtaacgtccgttcgttaccttcttaccgttcccttccccgtaacccg

SEQ ID NO: 364994 - DNA, 749 bp, Homo sapiens
  misc_feature: GZ8MTXP01B18HG.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtcctccatcccaccctgtctgcgtctctcggagacgagggtccaccgatcacttgcgggcaagtcagaactagttggactaacttactttaaattggtatcagcaagaagtcgagggaccaacgccccgaacctccgtagtactccgtaacggtacactaccctagtttcgacacgtaggtcgggtacctacccccgtagtacgtaaacgggttccaaggtacgggactaaggtaacgtacgttaccggtacgggtaaacctacgggttaaccttttaaccccactaacccgtacggttaccggtaacgggggttacctaacggtaacgtaccgttaaggtaaacgtttacgttttacggaaccgtttaactttaaaccgttaggtttacggtaacctaaacgttaacgggttacccgttttaaccccgtttccccgtaccccgggtaaccgggtttccggacccgggtaaacggaacccggtaaggtaacggaaacgttacggaacgacgtaaacgtcggttacggttcttacggtcctaaccgtcgttacgttcgttacctccgttaacgtttcccc

SEQ ID NO: 364995 - DNA, 628 bp, Homo sapiens
  misc_feature: GZ8MTXP01C4KMA.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtcaccatcacgttggtcggacaagtcaagaactagttggactaacttactttaaattggtatcgagcaagaacgtcgagggacaacgccccgaactcctagactcgtaacgtacactcctactttgacacgtagtcggactcccatacccgaaggttcaggtggacaagtacgtgtcgtagggtaaactacgttactttacccacaccagttcgagggtactacgacgtaccgtagtaaggttatttacggacttaacttactatttacggtaactaacgtacgttaacctttacccgtccgttaccccggagttccgacggaacggtaaccgaaggtacgaagtaacgaaacgcgtaaacgttcggtacgcgttacgccacgtaacttacgtcgttcttacttaccttccttcccgttaacc

SEQ ID NO: 364996 - DNA, 590 bp, Homo sapiens
  misc_feature: GZ8MTXP01EZAVB.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgcggcaagtcaagaacattggactaacgttactttaaattggtatcagcaagaagtcgaggaccaacgcccccgaaacctcctagactctaacggtacactcctactttgacacgagtggactccccatacaggttcagtgacaagtagagtctaggaactagtactttacccacacatcgagggtactacgacgtaccgtagaagttagttcgacgtaactttactagttagtacaactacgtacgttccctccgtaccccggtacgttccggaccgacgggaaccgaaggtaacgaacgttacgaacggttacgaacgtgttcggcgttcgcacgtaacttcgtcttacttccgttcgtttaaccccg

SEQ ID NO: 364997 - DNA, 561 bp, Homo sapiens
  misc_feature: GZ8MTXP01E0BH8.13.53.E09.1.454.CMB.2.raw
  modified_base (345)..(345): a, c, t, g, unknown or other
  modified_base (368)..(368): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaacctcctgatctacggtacatccactttgcacagtggatcccatccaaggttcagtgcaagtagntcgtagaacagtacttttacccncaccatcgaggggtctacacgcctagaagtatttcgacgtacttactattagtacaaactagtacgtttaccctcctcccccggtacgtcgtaccggacgtaacggtaacgaggtaagaacgaacgacgtacgttagtcggtcgacgcaccgtaactacgttctgttccttacgttaacccttcccgtaaccc

SEQ ID NO: 364998 - DNA, 709 bp, Homo sapiens
  misc_feature: GZ8MTXP01BFAD2.13.53.E09.1.454.CMB.2.raw
  modified_base (426)..(426): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgccgtctcgtcggagacgagggtcaccatcacgttgtcgggacaagtcaagaactagttcggactaacttacttaaattggtatcagtcaagaacgtcgacgggaccaacgacccccgaaacctccgtagtactaccgtaacggtacacttcctacttcgacacgtagtcggactacccccagtacgtaaaggtcgaggtcgactgtagactacgtaggaactacgtacttttacccnctaacgtatcggacgggtactacgacgtacgtagtaaacgttagtttacgtacgtaactttaaccttaggtttacgtaacgtaaacgtaacggttaaccgtttaccccgttcccggttaccccggtaaccggttaccggtaacccgggtaaacgggtaaccggtaaacgggtaaacggtaaacgttaacgtaaacggaaccggtaaacgttacgggttacgggttcgttactaaccggtaccgtcttaaccgttcgttaccttaaccgttaaccgtttccccg

SEQ ID NO: 364999 - DNA, 691 bp, Homo sapiens
  misc_feature: GZ8MTXP01B0X7L.13.53.E09.1.454.CMB.2.raw
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacgagggtcacctatcacttggtcggcaagtcagaacattggactaacttactttaaattggtatcagcagaagtcgaggccaacgccccgaactcctgactctacggtacactcctactttgcacgtagtcggtactccatacccgaaggttcaggtgacaagtagntcgtaagggtaaactacgttacttttacccacacctagtcgtacgggttactacgtacggtacccttaaggtaagtttacgttttacgaccgttaactttaacgttagttaacgtaacgtaaacgttaacggtttaaccgtttaccccgtttaccccgttaacccccgggttacggttaccgggtaacccggtaaacgggtaaacccgggtaaaggtaacggtaaaacgtaacgtaaacggacggttaaacgttcggtacggtcgttacgccgttaacctgttacttcgtttaacgttcttacctttcccgttccccgtaaccg

SEQ ID NO: 365000 - DNA, 660 bp, Homo sapiens
  misc_feature: GZ8MTXP01DJSL9.13.53.E09.1.454.CMB.2.raw
  modified_base (353)..(353): a, c, t, g, unknown or other
  modified_base (404)..(404): a, c, t, g, unknown or other
tcagtcacgtactacacgaccggtgctcgatttagagagagtgtgttgggtttggggggagtcagtctcagtcaggacacagcatggacatgagggtccccgctcagctcctggggctccctgctactctggctccgaggtgccagatgtgacatccagatgagccagtcctccatccaccctgtctgcgtctctcggagacagggtcaccatcacttgtcgggcaagtcagaacattggacactcttaatggtatcagcagaagtcgagggcaagccccgaacctcctgatctacggtacacgtccactttgcacagtggactcccgatcccaaggttcagtgacaagtagntctgggaacagtactttaccctcaccatcaggggtctacgagctagaagtnttttacgcgtaaccttatatttacggtacgtaactaacggtaacgtttaaccccgttaccgttacccccccgggtacggttttacccgggacccgttaaacgggggaaccccgtaaaacgggttagggggaaaacttaaccggtaaaacggaccggtaaaacgttcgggtaacgggtccgttacgggttcccgaaacccgtaacgtaacccttggttccctttccgttaacctttcccttttcccccggtaacccc

SEQ ID NO: 365001 - DNA, 713 bp, Homo sapiens
  misc_feature: GZ8MTXP01BVSZG.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtccacatcacgttgtcgggacaagtcaagaacattggactaacttactttaaattggtatcagcagaagtacgagggaccaacgaccccgaacctccgtagactaccgtacggtacaacgtccctacgttttcgactaacgtaggtacgggaactccccgaattacccgtaaaggttcgaggttcggacctaaaggttaacgtgttacgtaaggggaaacctaaggttaaccttttaacccccgacaaccctaacgtaccggtaaggggttacctacgacgtacccgtaggtaaacgtttagtttcgacgttaacctttacgttaactttacggtactaaacgtacgttaaccgtttaccccgttcccggtacccccggtacggttccggtaaccgtaaccgggtaaaccggtaacgggtaacggaaacgtaacgaaacggttacgtaaaccgttggtacggtcttcggaccacgtaatcctgttctcttcttaaccgttccctaaccg

SEQ ID NO: 365002 - DNA, 790 bp, Homo sapiens
  misc_feature: GZ8MTXP01D05KX.13.53.E09.1.454.CMB.2.raw
  modified_base (199)..(199): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcgganacgaggtcaccagtcacgttgtcgggacaagtcagaactgttcggacaacttctttaaatggtatcagctaggagtcgaggacaacgccccgaacctccgtagacttccgtaacggtacacttcctacgtttcgacgtacgtaggtacgggtacctccccgaagttacccgtaaacgggtttcgaaggttacgggacctaaaagggttaactaacggttacgtaacggggtaaaccttaacggtttaacctttttaacccccacggtaaccctacgtaaccgggtaacgggggttacctaaccgtaacggcccttaagggtaaattacgtttttcggaaccgttactttaacgttacgtttacggttaacctaaacgttacggttaacccgttttaccccgttaccccggttacccccggtaacgggtttacccggtaaccgggaaaccgggtaaccgggtaaaccggtaagggtaaaccgtaaacgaacgttaacgtaaccgttgggtacggtaccggttacgaccttaccccggttaagtcccgtttcgtttaacccttcgttacccttccccgttcccgttaaccccg

SEQ ID NO: 365003 - DNA, 643 bp, Homo sapiens
  misc_feature: GZ8MTXP01AH8NJ.13.53.E09.1.454.CMB.2.raw
  modified_base (315)..(315): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacagggtcaccatcacttggtcggacaagtcaagaactagttggactaaacttactttaaagtggtatcagcagaagtcgagggacaacgccccgaactcctgactcgtaacganactcctacttgacatgtcggactccctataccccgaaggttcaggtggactaaggtagaactcgtaagggaaacctagttaaccttttaccccactaccctacgtacgacggggttacctacgacgtcctaagtaaacgttcgtttagaccgttaactttacgtattacgaacgtaacgtaacgttaccgttaccccgtttcccgtacccccggttagtaccggaccggaacgggtaaccgtaaacgggtaggaaactaacgaacgacggtaaccgttgtccgattcgcacccgtaatcgttcttacttccacttccgttaacccgtc

SEQ ID NO: 365004 - DNA, 667 bp, Homo sapiens
  misc_feature: GZ8MTXP01EWPJZ.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgctctctcggagacagggtcaccatcacttgtcgggacaagtcagaacattggactaacttactttaaatggtatcagcaagaagtcgagggcaacgccccgaacctctgactcgtacggtacactccctactttcgacacgaggtcggactccccccgaatacgtaaaggttccaggttacggactaaggttagacgttcgtagggaaaccttacgtaacttttaccccactaaccctagtaccggtagggggtacctacgtaacgtccgttaaggtaacgttactttcgacgttaactttacgttacttaggtactaaacgtacgtacgttacccgtccgttaccccggtacggttccgaccggtaacggtaaccgtaagggtaacgtaaacgttacggaaacggacgtaacgtacggttacggttcgttacggtccacctaacgttcctcggttccttaacgttctttaaccccgg

SEQ ID NO: 365005 - DNA, 715 bp, Homo sapiens
  misc_feature: GZ8MTXP01AEDUE.13.53.E09.1.454.CMB.2.raw
  modified_base (221)..(221): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccacctgtctgcgtctctcggagacagggtcaccatcacttggcggnaagtcagaactagttggactaacttactttaaagttggtatcagcagaagtcgaagggccaacgccccgaactcctgactcgtacgtacactcctatttgacacgtaggtacggactccagtaccgtaaaggttcaggtcggacgtaaagtagtaattcgtaagggtaaactacgttacctttttaccccactacccgtacgttaccggtaaggggttacctaacgtacggtacccgttaaggtaaagttttacgtttttacggaaccgtttaaccttttaaaccggttatttaccggtaaacctaaacgtttaaccgggttaaccgttttaaacccccgtttccccgtaacccccgggtacggtttacccggtacccgggaaacgggtaacccggtaaagggtaacggtaaacggttaaccaaacggttacggtaaacgttggtacggtcgttacgcaccgtaatcgtcttactcttacgtccttccgtaacc

SEQ ID NO: 365006 - DNA, 694 bp, Homo sapiens
  misc_feature: GZ8MTXP01D39HO.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtctgcgtctctcggagacgagggtccaccatcacttggtcgggacaagtcaagaactagttcggactaacttactttaaattggtatcagtacaagaagtcgagggacaacgccccgactctgactcgtacgtacactcctatttgacacgtaggtcggactcccccgatcgtaaggttcaggtcgataagtagacttacgtacggtaaactaggttaacttttaccctactaaccgtacgtacggtacggggttacctaacgacgtaccttaggtaagttacgtttacgaccgttaacttaaccgtttatttacggtaactaaacgtacggttaaccgtttacccgttccccgttaccccggtaaccgtttccgggaacccgttaacggggaaccggtaacgggtaacggtaaacgttacggaaacggttacgtaaaccggtggttacgggttccttacggaacctaccgtaacttccgtcgtttaccttccgttaacgtttccccg

SEQ ID NO: 365007 - DNA, 548 bp, Homo sapiens
  misc_feature: GZ8MTXP01D5L9Z.13.53.E09.1.454.CMB.2.raw
  modified_base (201)..(201): a, c, t, g, unknown or other
  modified_base (295)..(295): a, c, t, g, unknown or other
  modified_base (348)..(348): a, c, t, g, unknown or other
  modified_base (356)..(356): a, c, t, g, unknown or other
  modified_base (359)..(359): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggcaagtcaagaacattggcaactcttaaaatggatcagcaagaagtcagggacaacgccccgtaaactccngatactacgtactatcccaatttgcacagtcggactacccccatacgaagttnaagtcganganatcgtagaactagtacttaccacacatcgaggtcacgacgctagaacttagttacgactaacttactagttacgtaacaaatacgtacgttaccgtaccgtaccgtacgtcgtacgacgacgaacgtaacgaacgaacgtaacgaacgtaacgtacgttagcgacgtcacaactctcttactcgttctc

SEQ ID NO: 365008 - DNA, 614 bp, Homo sapiens
  misc_feature: GZ8MTXP01BCFSM.13.53.E09.1.454.CMB.2.raw
  modified_base (241)..(241): a, c, t, g, unknown or other
  modified_base (467)..(467): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtccacatcacgttgtcgggacaagtcaagaacnttggctaactctttaaatggtatcagtcaagagtcgagggacaaccgccccgaactcctgactcgtacggtacacgtcctactttgacacgaggtcggacctacccctatacgtaaggttcaagttcgggacaaggtagacgtacgtagaactagtacttttacccacacgtacgtacgaggggttactactaacgtccgtaggtaatctttagactatttacgtnttacgtacaactaggtacttacccgttccgtaccccggtacgttaccggtaccgaacggtacccgagggtaaagaacgttacggaaacgttacggaacgtggttacgcgttacgaacactcgtactcgttcttcgttaacttccccg

SEQ ID NO: 365009 - DNA, 906 bp, Homo sapiens
  misc_feature: GZ8MTXP01AIIAL.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgccgtctcgtcggagacagggtacaccatcacgttggtacgggacaagtcaagaacagttcggactaacttacttttaaagttggtactacgagacaagtaagtacgaagggaccaaccggacccccgtaacctcctagacttaccgtaacggtactacttacctacgtttcgaccacgtaggtacgggtaccttaccccgattacccggtaaacgggttcgtagggtacgggtacgtaaacgggttaacggtcgttaaccgggtacgggtaaacgttaaccgtttaaccccgtttttaacccccacccgtaaaccccgttaacgttacccgggtaaccgggggtttaccctaaaccgggtaccggtttaccccgttaaaagggtaacgttttaaacgtttttaccgggaacccgttttaaaccttttaacgtttaaacgttttaccgtaaacccggtttaaaacggttaaccggtttaaccccgttttaaccccccggtttaccccccgggttacccccccggggtttaacggttaccccggggtaaaccccgggtaaaacgggtaaacccgggttaaagggtaaaccgggtaaacgttaaacccggaacgggttacccgaaacggttcgggtaacccggtcggttacccgaccggttaaccctcggtttccgttcctttacgttaccttccccggtttaacccttccccggttaaccccg

SEQ ID NO: 365010 - DNA, 650 bp, Homo sapiens
  misc_feature: GZ8MTXP01AQLC0.13.53.E09.1.454.CMB.2.raw
  modified_base (619)..(619): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacgttggcgggcaagtcagaactattggactaacttactttaaaagttggtaatcagcgaagaagtacgagggacaacgcccccgaactccgtgactaccgtacggtactacgtacctacgtttacgcacaggtacgggtactacccgactacgtacggttacgacgtggacgtaagttagaatacgtagggaaacctagtacctttaccctacaaccgtacgtcgtaacggggtcttaacgacgtccgtagtaagttagtttacgtcgtaaccctttattacgttcggtactaacgtaacggttacgttaaccccgttcccgtaccccgggtacgttaccggtacgaaccgggtacgaacggtacgaacgtaactaacgacgacgttgtaggccttacggcacgtntactcgttctcttacctccgttcccgtaacc

SEQ ID NO: 365011 - DNA, 805 bp, Homo sapiens
  misc_feature: GZ8MTXP01AEQGV.13.53.E09.1.454.CMB.2.raw
tcagtcacgtactacacgaccggtgctcgatttagagagagtgtgttgggtttggggggagtcagtctcagtcaggacacagcatggacatgagggtccccgctcagctcctggggctcctgctactctggctccgaggtgccagatgtgacatccagatgagccagtcctccatcccacctgtctgcgtctctcggagacgagggtcacctatcacttggtcgggacaagtacaagaactagttcggactaacttactttaaagttggtatcagtacagaagtcgacgggacaacgaccccgtaacctcgtcgactccgtacggtacactcctactttagcctacgaggtacggactcccgagtaccgtaacggttcgtaggtggacgtaacggttaagaactacgtacggaaacgtacgttaacctttttaaccccgactaacccgtagtacggtaacgggggttacctaaccggtacgtacgttaacgtaaaggtttacgttttacggaccgtttaactttaaccgttaagtttagtaaacccggtaaacgtttaaaccggttaaaccgttttacccccgtttaccccggttaacccccccgggggtacggtttaaccccgggtaacccgggtaaaaccggggtaaccccgggtaaaacgggtaaacgggtaaaacccgttaaccgggaaaacggttacggtaaaacccggttgggtaccggttacggttccgttacttacccggtaacgttacttccgtttaccttaccggttacctttaaccccgttcccgttaaccccc

SEQ ID NO: 365012 - DNA, 671 bp, Homo sapiens
  misc_feature: GZ8MTXP01CCA35.13.53.E09.1.454.CMB.2.raw
tcagtcacgtactacacgaccggtgctcgatttagagagagtgtgttgggtttgggggcaggagtcagtctcagtcaggacacagcatggacatggacgggtccccgctcagctccgtggggctcctgctactctggctccgaggtgccagatgtgacatccagatgagccagtctccatccaccctgtctgcgtctcgtcggagacgagggtcacatctacttgtcgggcaagtcaagaactattggctaacttacttaaattggatcagcaagaagtcgaggacaacgaccccgaactccagactactacgtactactcctattcgactacgagtcggactccccccagtacgtaaaggttccaagttgggactaaggtacgaacgttactacgggaaacttacgtaaactttttaccccactaaccctagtacgacggggttactaacgacgtaccgttagtaaacgttatttcgaacgttactttaaaccttagttactaaccgtaaactacgttaacctttaacccgttcccgttaccccggtacgtttcccggtaacgtaaacggacgtaaacggtaagggtaaacttccggaaaacgacggtaacgtcgttacggcgttacgtaacctactaacgtcttacgttccgttaaccttccgtaaccg

SEQ ID NO: 365013 - DNA, 694 bp, Homo sapiens
  misc_feature: GZ8MTXP01AU2E3.13.53.E09.1.454.CMB.2.raw
  modified_base (395)..(395): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacgagggtccaccatcacgttgtcgggacaagtcaagaactagttcgactaacgttactttaaagtggatcgagtacaagagtcgacgggacaaccgccccaactctcgactactacgtacacgtccctagtttcgactacgtggtacggactaccccctataccgtaaggttccaggtgactaagtacgntacgtaggaactaggttactttacccacactaagtcgtacgggtactacgacgtcgtagtacgttacgttacgtctaacgtttacttaggttacgtaacgtaaacgttacgttacccgtttacccttaccccgggtacccccggttacggttcccggaaccgggtaaaccggggtaaaccggaacgggttaaacggtaaacgttaacgaaaccggttaccgtaaaccggttaacgttcggttacgcgtaacgtaacccgtaacttcgttaccggttcctttaacgttaacctttccccg

SEQ ID NO: 365014 - DNA, 710 bp, Homo sapiens
  misc_feature: GZ8MTXP01ACNS8.13.53.E09.1.454.CMB.2.raw
  modified_base (347)..(347): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacgagggtccactatctacgttcggcggacaagtcaagtaactagttggactaacttactttaaagttggtatcgagacagaacgtcgacggacaaccgccccgaacctcctgtactacgtaacgtacactcctagttcgactacgnggtacggtactcctagtaccgtaaggttcgagtcggactaaaggtataacgtacgtaacggtaactaacgttacctttacccacgtaacctacgttacggaacgggttactaacgtacgtaccgtaaggtaaattacgtttacggacttaactttacgttaagttacgtaactaaacggtaccgttacccgtttaaccccgttaccccggttacccccgggtacgtacccgggaaacggtaaccggtaacggtaaacggtaacgggaaacgttaaccggaaagttaccgggtaacgttggttcggaccgttcgaccgacctaacgttcgtaactttcctacttccgttcccgttcccgtaacc

SEQ ID NO: 365015 - DNA, 804 bp, Homo sapiens
  misc_feature: GZ8MTXP01BLZJS.13.53.E09.1.454.CMB.2.raw
  modified_base (436)..(436): a, c, t, g, unknown or other
tcagtcacgtactacacgaccggtgctcgatttagagagagtgtgttggggtttgggggagtcagtctcagtcaggacacagcatggacatggagggtccccgctcagctccgtggggctcctgctactctggctccgaggtgccagatgtgacatccagatgagccagtcctccactccaccctgtctgcgtctcgtcggagacgagggtccaccatctacgttggtccggggactaaggtacaagaactagttcggactaaacttctttaaatggtatcagcagaagtcgagggacaacgccccgtaactctagactactacggtacactccgtactttcgactacgaggttacggactcccagtaccgaaggtttcaggttcggacgaaagttaagtcgtacgtacgggaaactacggttaacttttaccccnctaaacccgtagtaccgggtaacgggggttacctaacgaccgtaccgttaaggtaacgtttagttttacggaccggtttaactttaacgttaaacgtttaccgtaaccggtaaacgttaaccgggtttaacccttttaacccccggtttacccgttaccccccccgggtaacgggtttacccggtaaaccccgggtaaaacgggtaaccccgggtaaaacgggttaacgggggaaaacttaaacgggaaacggttaacgggtaaacccgttagggttaccggtaacgttccgggttaccgaaccctttaaggtccgtttaacgtttacccttaaccgttcctttaacccggtttccccttaaacccgg

SEQ ID NO: 365016 - DNA, 594 bp, Homo sapiens
  misc_feature: GZ8MTXP01A55D7.13.53.E09.1.454.CMB.2.raw
  modified_base (282)..(282): a, c, t, g, unknown or other
  modified_base (294)..(294): a, c, t, g, unknown or other
  modified_base (306)..(306): a, c, t, g, unknown or other
tcagtcacgtactacacgaccggtgctcgatttagagagagtgtgttgggtttgggggagtcagtctcagtcaggacacagcatggacatgagggtcccgctcagctcctggggctcctgctactctggctccgaggtgccagatgtgacatccagatgagccagtctccatccacctgtctgcgtctctacggagacagggtcaccgatcacttgtcgggcaagtcagacattggcactcttaaatggtatcagcagagtcagggcaagccccgaactccngatctacggtanactccagtttcncacgtagcggtactccgtagtaccgtaaggtcgtagtcggacgtaagtagtaacgtacgtacgtaacgtacgtactttacctactactacgtacgtacggtacgtacgacgtacgtacgtagttagttacgtacgtacttacttacttagtacgtaacgtaacgtacgttaccgttaccgtcccgtaccggtacgtaccgaacggtaaccggtaacggtaacggaacgtaacgaacgacgacgttacgtacgtcgcgcgacaactctctctcttactccttccgtccg

SEQ ID NO: 365017 - DNA, 636 bp, Homo sapiens
  misc_feature: GZ8MTXP01DJLIS.13.53.E09.1.454.CMB.2.raw
tcagtcacgtactacacgaccggtgctcgatttagagagagtgtgttgggtttggggggagtcagtctcagtcaggacacagcatggacatgagggtccccgctcagctcctggggctcctgctactctggctccgaggtgccagatgtgacgtccagatgagccagtctccatccaccctgtctgcgtctctcggagacagggtcaccatcacttgtcgggacaagtcaagaacattggactaacttactttaaattggtatcagcagaagtcgagggacaacgcccccgaactcctagactactacggtacactcctactttcgacaacgaggtggactcccaatcgtaacgttcgagtggacagtaaagatcgtaggaaactagttactttaccccacaacctatacgtagggtacaacgacgaccttagaacgttattttgaccgtaacttacgttattcgtaacaaacggtacgttaaccgtttacccgttccccgtaccccgggtcgtaccggtaccggaaaccggtacggaaacggtaggtaaacgtaacgtaacgtaacggacgtaacggttgtacgtcgacgttaccactcttacttcttcctacttcccttcccgttccgtaaccg

SEQ ID NO: 365018 - DNA, 801 bp, Homo sapiens
  misc_feature: GZ8MTXP01DTPH9.13.53.E09.1.454.CMB.2.raw
  modified_base (352)..(352): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgagtgccagatgtgacatccagatgagccagtcctccatcccaccctgtctgcgtctcgtcggagacagggtcaccatcacttggtcgggacaagtcaagaactagttggactaacgttactttaaagttggtaactcgagacaggtaagtacgacgggacaaccgaccccgaacctccgtagactacgtacggtacactacctacgtttcgactacncggttacgggactaccccgtaatacccgtaaagttcgaggttacgggactaagggtaactaacgtacgtaacgggtaaactacggtttaaccccttttaaccccactaacccgtacgttaccggtaacgggggttacctaacgaccgttacccggttaaggtaaacggtttaacgttttacgggacccgttaactttaaacgttacgtttaaccgggttaacctaaacgttaaccggtttaacccgtttaccccgtttaccccggttaacccccgggtaccggtttaccgggaaaccccggtaaccggggtaaacccggtaaggggtaaacgtaaaccgttaacgaaacggttaccgggtaaacgttacgggtacggtacgttaccggacttaacccggtaactccgttaacgttccttaacggacctttcccggttaacccgttaacc

SEQ ID NO: 365019 - DNA, 750 bp, Homo sapiens
  misc_feature: GZ8MTXP01CVFSK.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctccgtggggctcctgctactctggctccgaggtgccagatgtgacatccagatgagccagtctccactccacctgtctgcgtctcgtcggagacgagggtccaaccgtatctacgttggtaccggggactaaaggtaccaaggtaactaagtttcgggaactaaacgttacgttttaaaagttggtaacttacgaagtaccgaaggaacggtacgaacggggaccaaaccggcccccgaaacctcccgtagtactaccgtaacgtacacttcctactttgaccacgtagttacggactccgattacccgtaaaggttcgagggtacgagtaaagtacgtaagtaccgtagtaaacgtacgtttaaacctttccccactaacccgtattacggagggttacctaacgacgtacgtaacgtaaggttacttttacggaccgttaatttaaccgttatttacggtaacctaaacgttaaccggtaccgtttaacccgttccccgtacccccgggtacgttaaccggaccgttaaaccggtaacggaaacgttacggaaagaacccgtaaaggcccgaaattcgggtaaagccgttagcccgttataagttcgtcgtccttacgttaccttaacccgttcccgtcg

SEQ ID NO: 365020 - DNA, 720 bp, Homo sapiens
  misc_feature: GZ8MTXP01A0XCK.13.53.E09.1.454.CMB.2.raw
  modified_base (229)..(229): a, c, t, g, unknown or other
  modified_base (686)..(686): a, c, t, g, unknown or other
  modified_base (693)..(693): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcaccatcacgttgtcggganaagtcaagaactagttggactaacttacttaaagttggtaatcgagcaagaagtcgaagggacaaccgacccccgaaacctccgtagactcgtaacggtacacttccctactttcgacctacgtaggtcggacttaccccccccgaagtacgaaagggtttccgaagttacgggacgtaaggtacgtaattaccggtacgggtaaaacctacggttactttttaaacccccgtacctaaccgtaaactcccgggtaaggggttacccttaacgaacgtacccgttaagtaaagttcgtttacggtacgttaactttaaccgttgttaacgtaccgtaaacgacgttaaccgtttaaccccgttcccgtacccccggtaaggtttccccgaacccgggtaaggaccgtaacgggtaaacggtaaagttacgaacgacgtaaacgtggttcggttcacncccgtanaacgtctcgttacgtcttcgttaaccc

SEQ ID NO: 365021 - DNA, 592 bp, Homo sapiens
  misc_feature: GZ8MTXP01AKLSS.13.53.E09.1.454.CMB.2.raw
  modified_base (247)..(247): a, c, t, g, unknown or other
  modified_base (262)..(262): a, c, t, g, unknown or other
  modified_base (320)..(320): a, c, t, g, unknown or other
  modified_base (381)..(381): a, c, t, g, unknown or other
  modified_base (543)..(543): a, c, t, g, unknown or other
  modified_base (570)..(570): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtcacctatcctacgtttggcgggacaagtcaagaactnttcggactaaacttnttaaatggatcagacagagtcgaggacaacgccccgaactcctgacttctaacggacnctccctaagttgaccagaggtggaacctcccatacggtaaagttcgaggtcggacaagtanagttcgaggaacagtacttttacccgacactaagtcgaagggtctacgacgacctagtaagttcgttacgactacttaacgtagtcgttacaaacgtggttaacctcccgtttcccgaccccggtaacggttcgacgaacggtaccgaaaggtggaaacttnacggactagtgttacggcttcgaaccnctctcgtcttctcttcgtcccg

SEQ ID NO: 365022 - DNA, 576 bp, Homo sapiens
  misc_feature: GZ8MTXP01AQIZ3.13.53.E09.1.454.CMB.2.raw
  modified_base (295)..(295): a, c, t, g, unknown or other
  modified_base (556)..(556): a, c, t, g, unknown or other
  modified_base (561)..(561): a, c, t, g, unknown or other
  modified_base (570)..(570): a, c, t, g, unknown or other
tcagtcacgtactacacgaccggtgctcgatttagagagagtgtgttgggtttggggggcaggagtcagtctcagtcaggacacagcatggacatgagggtccccgctcagctcctggggctcctgctactctggctccgaggtgccagatgtgacatccagatgagccagtctccatccaccctgtctgcgtctctcgggagacagggtcaccatcacttggtcgggcaagtcagaacattggacaactcttaaatggtatcagcagaagtcgaggcaacgccccgtaactccngactctacggtacactcctacttgcacgagaggactccccatacaaggttcagtagctaagagtatcgagaactgtacttttacccacacatacgacgggtcttacgacgtcctagtaacgttacgtttagtacgtaactttacgttaactttacgtacgtaaactacgtaaccgtttacccttcccgtaccccgggtacgtccgtacgtacggaaccgagggtaacgaattaccgaggacgacgtagttgacttgaacanaactntacgttctnaactcc

SEQ ID NO: 365023 - DNA, 634 bp, Homo sapiens
  misc_feature: GZ8MTXP01CLZP7.13.53.E09.1.454.CMB.2.raw
  modified_base (393)..(393): a, c, t, g, unknown or other
tcagtcacgtactacacgaccggtgctcgatttagagagagtgtgttgggtttggggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcattgtacgggcaagtcagaacattggctaacttactttaaatggtatcgagctagaagtcgagggtacaacgaccccgaactcctagactactacggtacatcctattgacacgagtggactaccccatcaaggtccagtagggctaagagtactgtaggaactagtactttacccncacctatacgaggtacaacgacgtccgtagaattacgtttacgacgtaacgtttacttaaggttacgtacgtaaactaggtaccttaacccttccgttaccccgggaacgtttccgggacccaaacggggtaaccgaaacgggttaacggaaaacgttacggaaaacttaaacggtacgtacggttacgttccgggacaacctagtccttaggtcctttactaaccttcccgtttaacccg

SEQ ID NO: 365024 - DNA, 507 bp, Homo sapiens
  misc_feature: GZ8MTXP02IL5ZB.13.53.E09.1.454.CMB.2.raw
  modified_base (340)..(340): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcaggcaagccccgaactcctgatctacggtacatccactttgcacagtggatccccatcaaggttcagtgcngtagatctgaacagatttacctcacatcaggggtctacagcctgaagatttgcgtacttactaattgtacaacagagttaccttctccccggacgttcggcctaagggaccaaggtaggaaaatcaaacgacgaaactgtacggctgcaccatctgtctttcattcc

SEQ ID NO: 365025 - DNA, 532 bp, Homo sapiens
  misc_feature: GZ8MTXP02JFKC4.13.53.E09.1.454.CMB.2.raw
  modified_base (344)..(344): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatcccatccaaggttcagtggcagtagntctggaacagtatttaccctcaccatcgaggggtctacagcctagaagtattttgcgtacttactattgtacaactagtagtttaccttctcccccggtacgttccggaccgaacgggaccgaaggtaggaaactacaaagacgaaacgtgtacggctcgcacaacgtctcgtcttcactctccgtcc

SEQ ID NO: 365026 - DNA, 565 bp, Homo sapiens
  misc_feature: GZ8MTXP02G1USH.13.53.E09.1.454.CMB.2.raw
  modified_base (341)..(341): a, c, t, g, unknown or other
  modified_base (363)..(363): a, c, t, g, unknown or other
tcagtcacgtactacacgaccggtgctcgatttagagagagtgtgttgggtttggggagtcagtctcagtcaggacacagcatggacatgagggtcccgctcagctcctggggctcctgctactctggctccgaggtgccagatgtgacatccagatgagccagtctccatccaccctgtctgcgtctctcggagacagggtcaccatcacttgcgggcaagtcagaacattggcaactcttaaattggtatcagcagaagtcagggcaagccccgaactcctgactctacggtacatccactttgcacagtggatccatccaaggttcagtggcagtagntctggaacagtacttttacccncaacccatcgtaggggtctacgagcctagaagtatttgcgtacttactattgaccaactagtacgtttaccttccgtacccccggtacgttaccggaccgtaaacggggacccaaaggggtagaaacgttacgaaaacggacgtaaaccgtagtagggctcggcaccaatcctagttccttactacttccttacccggtccc

SEQ ID NO: 365027 - DNA, 524 bp, Homo sapiens
  misc_feature: GZ8MTXP02HM80K.13.53.E09.1.454.CMB.2.raw
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggcaagtcagaacattggcaactcttaaatggtatcagcagagtcagggcaagccccgaactcctgatctacggtacatccactttgcacagtggatcccccatcaaggttcagtggcagtagatctaggaacagaactttttacccacaccattacgaggggtctacagcctagaaagtattttgacgtaactttactattgttacaacaggtattaccttctccccggagtccgtacaacggaccgaagtacggaaaatcaaagtcgaaactcgtagctgcgaccatctgtctactatccc

SEQ ID NO: 365028 - DNA, 566 bp, Homo sapiens
  misc_feature: GZ8MTXP02HJRN8.13.53.E09.1.454.CMB.2.raw
  modified_base (341)..(341): a, c, t, g, unknown or other
  modified_base (368)..(368): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccatttgcacagtggatcccccatcaaggttcagtggcngtagatcgtggaacagacttttacccncaccatcaggggtctacagcctagaagtatttgacgtacttacttattgttacaactagtacgtttaaccttccgtcccccggtacgtttccggaccgtaacgggaccgtaacggtaggaaaacgtacgaaacggaccgaaacgtcggttacggacgttcggaaccgacctaacgtctggtcctttactactttcccg

SEQ ID NO: 365029 - DNA, 516 bp, Homo sapiens
  misc_feature: GZ8MTXP02GJ88Y.13.53.E09.1.454.CMB.2.raw
  modified_base (344)..(344): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgatatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtgggatcccccatcaaggttcagtggcngtagatctggaacagatttaccctcaccatcaggggtctacagcctgaagattttgcgacttactattgtcaacagagttaccttctcccccggacgttcgccgaacggaccgaaggtacggaaagtacaacgacgaacgtagtacggctgcgacactctgtcttcacttcc

SEQ ID NO: 365030 - DNA, 608 bp, Homo sapiens
  misc_feature: GZ8MTXP02H5ZZT.13.53.E09.1.454.CMB.2.raw
  modified_base (356)..(356): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggcaagtcagaacattggcaactcttaaatgtatcagcagagtcaggcaagccccgaactcctgatcacggtacatccatttgcacagtggatccatccaagttcagtggcagtagatctaggaacagtacttttacccncaccatcagggtctacagcctagaagtatttgacgtacttaactatttgttacaaactagtaacgtttaaccttccgtaccccccggtaacgtttccgggtacccgaaacggggaacccgtaaaggggtaacgggaaaaacttaccgaaaaggtaccggaaaaccgttcgggtaagggtccttacggtaccaacccgaaacgttccttacggttacctttccaaacctttcccgttttaacccccggtaccc

SEQ ID NO: 365031 - DNA, 537 bp, Homo sapiens
  misc_feature: GZ8MTXP02FSWAD.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcaggcaagccccgaactcctgatctacggtacatccactttgcacagtggatccatccaaggttcagtggcagtagatctaggaacagtactttacctcacatcaggggtctacagcctagagtatttgcgtacttactattgtacaactagtactttaaccttcctacccccggtagttcggaccgtaacgggaccaaggtacgaaatacgaacgacgaacgtagtagtcgtcgctaccaacgtactcgtcttactactccttcccgtacc

SEQ ID NO: 365032 - DNA, 529 bp, Homo sapiens
  misc_feature: GZ8MTXP02F7JKD.13.53.E09.1.454.CMB.2.raw
  modified_base (363)..(363): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggcaactctttaaatggtatcagcagaagtcagggcaagccccgaactcctgatctacgtacatccatttgcacagtggatccatccaagttcagtggcagtagatctaggaaacagtacttttacccncaacctatacgagggtctacagcctagagtatttgcgtactactattgtacaactagtacgtttacctccgtacccccggtacgttcgtacccgaacggaccgaaggtacggaaactacgaagacgaactagtaggctcgcacaactctctactctactctcctcc

SEQ ID NO: 365033 - DNA, 614 bp, Homo sapiens
  misc_feature: GZ8MTXP02GQ8M1.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtggatcccatccaaggttcagtggcagtagatctaggaaactagacttttacccacacccatcgaaggggtctacgagcctagaagtatttgacgtacttactattgtacaactagtacgtttaacccttccgtaccccccggtaacgtttccggacccgtaaacggggacccgtaaaacgggtcgggtaaaaacgttacgaaaacggaccgtaaaaccgttaggtacgggtacccgttcggaccgtaacccgaacttccgtacgtttacctttctaactttccctttacccccgtccc

SEQ ID NO: 365034 - DNA, 554 bp, Homo sapiens
  misc_feature: GZ8MTXP02JV63F.13.53.E09.1.454.CMB.2.raw
  modified_base (343)..(343): a, c, t, g, unknown or other
  modified_base (364)..(364): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatcccatccaagttcagtggcagtagntctggaacagacttttacccncaccatcgaggggtctacagcctagaagtattttgacgtactttactattgttacaaactagtacgtttacccttcctacccccgggacgtttcggacccgtaaacggggacccgaaagggtaggaaaacgtacgaaacgacgaaactggtcggctacgcaccaagtctcgtcttcacttccttcccgcc

SEQ ID NO: 365035 - DNA, 587 bp, Homo sapiens
  misc_feature: GZ8MTXP02GXN6T.13.53.E09.1.454.CMB.2.raw
  modified_base (343)..(343): a, c, t, g, unknown or other
  modified_base (365)..(365): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatccatccaaggttcagtggcagtagntctggaacagtacttttacccncaccatcgagggtctacagcctagaacgtattttgcgtacttactattgtcaaactgacgtttaccttcctacccccggtacgtttcggaccgaaacggggaccaaagggtacggtaaaagttaccgaaaacggaccgtaaaaccgttggtacggtaccgtcggacctaaccgaacgttcctacggttacctttccgtaacgttcccgtttacccccgtccg

SEQ ID NO: 365036 - DNA, 563 bp, Homo sapiens
  misc_feature: GZ8MTXP02JQ615.13.53.E09.1.454.CMB.2.raw
  modified_base (310)..(310): a, c, t, g, unknown or other
  modified_base (340)..(340): a, c, t, g, unknown or other
  modified_base (349)..(349): a, c, t, g, unknown or other
  modified_base (360)..(360): a, c, t, g, unknown or other
  modified_base (562)..(562): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacngtggatccgatccaagttcagtggcagtantctggaacngtatttacccnaccatcgagggtctacagcctagaagtattttgacgtacttaactagtttgtacaacgtagtacgtttaacccttccgtacccccgggtacgtttaccggacccgtaaaggggacccgtaaagggtaggaaaacttacgaaacgacgtaaaccgtcggtgcgtacgaccacctaatcctgtaccttacacttccgttccccnc

SEQ ID NO: 365037 - DNA, 516 bp, Homo sapiens
  misc_feature: GZ8MTXP02HRQ1X.13.53.E09.1.454.CMB.2.raw
  modified_base (342)..(342): a, c, t, g, unknown or other
  modified_base (367)..(367): a, c, t, g, unknown or other
tcagtcacgtactacacgaccggtgctcgatttagagagagtgtgttgggttttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcagggcaagccccgaactcctgatctacggtacatccactttgcacagtggactccccatcaaggttcagtggcngtagatctgaacagtattttacccncacatcaggggtctacagcctagaagtatttgcgtactttactattgtacaacagtacgttaccttctccccggacgttcggaccaacgggacaacggtaggaaatacaacgacgaactgtacggctgctacactctgtctctacttcc

SEQ ID NO: 365038 - DNA, 530 bp, Homo sapiens
  misc_feature: GZ8MTXP02JUWEF.13.53.E09.1.454.CMB.2.raw
  modified_base (363)..(363): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatcccatccaaggttcagtggcagtagatctggaacagatttacccnaccatcaaggggtctacagcctagagattttgcgtacttactattgtacaactagtagtttaccttctcccccggacgttccggaccgaacgggtacccaagggtacggaaaatacgaaagcgaaacgtgtcggactcgcaccaatctcgtcttcactccttccgcc

SEQ ID NO: 365039 - DNA, 512 bp, Homo sapiens
  misc_feature: GZ8MTXP02J219U.13.53.E09.1.454.CMB.2.raw
  modified_base (360)..(360): a, c, t, g, unknown or other
  modified_base (385)..(385): a, c, t, g, unknown or other
  modified_base (494)..(494): a, c, t, g, unknown or other
  modified_base (501)..(501): a, c, t, g, unknown or other
  modified_base (511)..(511): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactcttaaatggtatcagcagaagtcagggcaagccccgaactcctgatctacggtacatccactttgcacagtgggatccatccaagttcagtggcagtagatctaggaacagattttacccnaccatcaggggtctacagcctgaanattttgcgtacttactattgtcaacagattaccttctaccccggacgtttcggaccgaacgggaccaaggtaggaaatcgaaagcgaaactgtggcagcaccaatcgtntcttacnctctttcccnc

SEQ ID NO: 365040 - DNA, 543 bp, Homo sapiens
  misc_feature: GZ8MTXP02GB3T4.13.53.E09.1.454.CMB.2.raw
  modified_base (362)..(362): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatccatcaagttcagtgcagtagatctaggaacagtattttacccnctaccatcaggggtctacagcctagaagtatttgcgtacttactattgtacaaactagacgttaacccttctacccccggtacgttcggtaccgaacgggaccgaaacggtacggaaagtacgaaacgacgaaactagtacggctacgcaaccaacgtctgtacttctactcttcccgtcc

SEQ ID NO: 365041 - DNA, 529 bp, Homo sapiens
  misc_feature: GZ8MTXP02I01EE.13.53.E09.1.454.CMB.2.raw
tcagtcacgtactacacgaccggtgctcgatttagagagagtgtgttgggttttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcaggcaagccccgaactcctgatctacggtacatccactttgcacagtggatccccatcaaggttcagtgcagtagatctaggaacagatttaccctcaccatcaggggtctacgagcctagaagtatttgcgtacttactattgtacaaactagtaacgttacccttcgtacccccggacgttcggccgaaacgggaccaaaggttacggaaataccgaaagacgaaactcgtaggtctagcgacatctgtcttcattcc

SEQ ID NO: 365042 - DNA, 599 bp, Homo sapiens
  misc_feature: GZ8MTXP02HE6GH.13.53.E09.1.454.CMB.2.raw
  modified_base (342)..(342): a, c, t, g, unknown or other
  modified_base (365)..(365): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatccatccaagttcagtggcagtagntctggaaacagtacttttacccncaccatcaggggtctacagtcctagtaagtattttggactacttaactattgtacaaactagtacgtttacccttccgtacccccggtaacgttcggtaccgaaacgggaacccgtaaagggtacgtaaaacgtaccgaaaacggaccgtaaaaccgtggttacgggtacgtcggtaccgaacctaacgtccttacggttcctttacctactttacccgtttacccccgtaccc

SEQ ID NO: 365043 - DNA, 547 bp, Homo sapiens
  misc_feature: GZ8MTXP02JWRFH.13.53.E09.1.454.CMB.2.raw
  modified_base (369)..(369): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaagccccgaactcctgactctacggtacatccactttgcacagtggatcccatccaaggttcagtggcagtagatctaggaactagtacttttacccnacccatcgaggggtctacagcctagaagtattttgacgtacttactattgtacaacagtacgtttacccttccgtacccccggacgttccggaccgaaacgggaccgaagggtacggaaatacaaaggcgaacgtagtcggactcgcaccaatcctgtcttctacttccttcccgacc

SEQ ID NO: 365044 - DNA, 545 bp, Homo sapiens
  misc_feature: GZ8MTXP02I55PY.13.53.E09.1.454.CMB.2.raw
  modified_base (339)..(339): a, c, t, g, unknown or other
  modified_base (361)..(361): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacagtggatccatccaagttcagtgcagtagntctggaactagtactttacccncaccatcgagggtctacgagcctagagtatttgcgtacttactattgtacaactagtacgtttaccttccgtacccccggagtttccggaccgtaaacgggaccgaaggtacggaaaacgtacgaaaggccgaaacgtggtacggtctcgccaccaagtctcgtcttcacttccttacccgtcc

SEQ ID NO: 365045 - DNA, 586 bp, Homo sapiens
  misc_feature: GZ8MTXP02G0FZ0.13.53.E09.1.454.CMB.2.raw
  modified_base (370)..(370): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaacgccccgaactcctgatctacggtacatccactttgcacagtgggatcccatccaaggttcagtggcagtagatctaggaactagtacttttacccncaacccatcgaggggtctacagcctagaagtatttgcgtacttactattgtacaactagtacgttaccttccgtaccccggtacgttaccggaccgaaacgggaccgtaaacgggtacggtaaaacgttacgaaaacggacgaaaccgtaggtacggtcgtacggaccaccgtaacgtccttacggttcttacctacttcccgtttaccccgtacc

SEQ ID NO: 365046 - DNA, 607 bp, Homo sapiens
  misc_feature: GZ8MTXP02G231C.13.53.E09.1.454.CMB.2.raw
  modified_base (366)..(366): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcaggcaagccccgaacctcctgatctacggtacatccactttgcacagtgggatcccatccaaaggttcagtggcagtagatctaggaacagacttttacccncaccatcaggggtctacgagccctagaagtattttgacgtactttactattcgttacaactagtacgtttacccttcctcccccggtacgtttaccggccgtaaacggggacccgaaaggggtacgaaaacgttacgaaaggaccgtaaaccgttcggtaagggtccgttacggacctaacccgtaacttacggttaccgttcctttacgtaaccgtttcccctttaccccggtaaccccg

SEQ ID NO: 365047 - DNA, 554 bp, Homo sapiens
  misc_feature: GZ8MTXP02F05XH.13.53.E09.1.454.CMB.2.raw
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggcaagccccgaacctcctgatctacggtacatccactttgcacagtggatcccatccaaggttcagtggcagtagatctaggaacagacttttacccncaccatcgaggggtctacagcctagaagtattttgcgtaacttactattgtacaactagacgtttacccttcctacccccggtacgtttccggaccgtaaacgggaccgaaacggtacgggaaaactacgaaacgacgaaaccgtgtacggcgtcgcaccgaatctcgttcttcactcttcccgtcc

SEQ ID NO: 365048 - DNA, 595 bp, Homo sapiens
  misc_feature: GZ8MTXP02IMFRZ.13.53.E09.1.454.CMB.2.raw
  modified_base (285)..(285): a, c, t, g, unknown or other
  modified_base (367)..(367): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatctaccctgtctgcgtctctcggagacagggtcaccatcacttgtcgggcaagtcagaacattggcaactcttaaattggtatcagcagaagtcagggcaagccccgaactccngatctacggtacatccactttgcacagtggactcccatccaaggttcagtggcagtagatctggaaacagtacttttacccncaccatcgaggggtctacagcctagaacgtatttgcgtacttactattgtacaacagtacgtttaccttccgtacccccggtacgtttccggaccgtaaacggggacccgtaaaaggggtacggaaaacttaccgaaaacggccgaaaaccgttggttacgggccgttacggccaacccgaagttcccttagttaccctttctaactttccctttacccccggtaccc

SEQ ID NO: 365049 - DNA, 649 bp, Homo sapiens
  misc_feature: GZ8MTXP02F55DM.13.53.E09.1.454.CMB.2.raw
  modified_base (362)..(362): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttgtcggacaagtcagaacattggacaacttctttaaatggtatcagcagaagtcgaggcaacgccccgaactccagactctacggtacactcctactttcgacacgtagtgggactacccataccgtaaaggttcagtggacagtagntacgaggaactacgtactttacccacactagtcgtagggtactaacgacgacgttagaagttacgtttggacttaacttacttaagttacgtacaaacgtacgtacgtttacccttaccgtacccccggtacgtttccggaccgaaacgggaccgaaacgggttagaaaacgttaacgaaacggtacgtaaacgtcggtacgggtaccttacggaccgtaacccgtaaacgttaccgttcgtttaacccgtttcctaaactttaccccggtttcccgtttaaccccg

SEQ ID NO: 365050 - DNA, 662 bp, Homo sapiens
  misc_feature: GZ8MTXP02HDQVD.13.53.E09.1.454.CMB.2.raw
  modified_base (263)..(263): a, c, t, g, unknown or other
  modified_base (631)..(631): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcgagtagngacgacaccgacccgacctcgagtactacgtacgtactacctaccttacgtttcgactacgtacgggtacggtacctacccgtataacccggttacgttaccgagggtaccggacgtaaggtagtacgttacggtaacggtaaacgtacgtttaaaccctttttacccccgaactaacccgtacgttacgggtaccggggttaacctaacggaccgtaccgtaaaggtaagtttacgttacgggaccttacctttaacttagttccgaaacctaagtagttaacccgtttacccgttcccgtacccccgggtagttccgaaccggaacggacgtaaggtaagaacctaagacggactacgtgcggccncgactactgtctacgttctactcctacctca

SEQ ID NO: 365051 - DNA, 605 bp, Homo sapiens
  misc_feature: GZ8MTXP02IR62R.13.53.E09.1.454.CMB.2.raw
  modified_base (284)..(284): a, c, t, g, unknown or other
  modified_base (342)..(342): a, c, t, g, unknown or other
  modified_base (363)..(363): a, c, t, g, unknown or other
  modified_base (379)..(379): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcngatctacggtacatccactttgcacagtggactcccatccaaggttcagtgcagtagntctggaacagtactttacccncaccatcagggtcacngcctagacgtatttgacgtacttactattcgtacaaacgtagtacgtttacccttaccgtcccccggtacgttccggaccgaaacggggtacccgaaagggttacggaaaacgttaccgaaaacggtaccggaaacgttacggtcggtaccgttacggacccgtaacccgtaagttccgttacggtttaccctttacgtaaccgtttcctttacccccggtacccg

SEQ ID NO: 365052 - DNA, 571 bp, Homo sapiens
  misc_feature: GZ8MTXP02JLOSI.13.53.E09.1.454.CMB.2.raw
  modified_base (235)..(235): a, c, t, g, unknown or other
  modified_base (341)..(341): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacnttggcactcttaaatggtatcagcagagtcaggcaagccccgaaactcctgatctacggtacactcctactttgcacagtggactccccatcgaagttcaggtgcngtagatcgtagaactagtacttttacccacacctatcgacgggtctaacgagcctagtaagtatttgacttacttactaattcgtactaacctagtacgtttacccttcccgtacccccgggtgttaccggaccgtaaacggggaaccaaacggggttagaaagttaccggaaagacgtaaacgtcgtacggtcgtacgccgaacctagtccctgtccttcactttcccc

SEQ ID NO: 365053 - DNA, 561 bp, Homo sapiens
  misc_feature: GZ8MTXP02G3KW7.13.53.E09.1.454.CMB.2.raw
  modified_base (283)..(283): a, c, t, g, unknown or other
  modified_base (340)..(340): a, c, t, g, unknown or other
  modified_base (361)..(361): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcaggcaagccccgaactcngatctacgtacatccactttgcacagtggatcccatccaaggttcagtggcagtagntctaggaacagtactttaccncacatcgagggtctacagcctagaagtctttgacgtacttactattcgtacaaacgtagtacgtttacccttccgtacccccgggtaacgttccggaccgaaacgggaaccgaaacgggttaggaaaactcgaaaacgacgtaaactggtacggctacggctaaccgaatacgtcgttcttactactccttacccgtacc

SEQ ID NO: 365054 - DNA, 570 bp, Homo sapiens
  misc_feature: GZ8MTXP02H07NN.13.53.E09.1.454.CMB.2.raw
  modified_base (340)..(340): a, c, t, g, unknown or other
  modified_base (365)..(365): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcaggcaagccccgaactcctgatctacggtacatcactttgcacagtggatccatccaagttcagtggacagtagntcgtaggaactagtacttttacccncaccatcgagggtctacgacgctagaagtattttgacgtacttaactattagtacaaacgtagtacgtttacccttccgtaccccggtaacgtttccgggacccaaggggaacccgtaaagggtagggaaaactacgaaaacggtcgaaaacgtggtacggcgtacgcaacctaatccgttagtcttcacttcctttacccgacc

SEQ ID NO: 365055 - DNA, 535 bp, Homo sapiens
  misc_feature: GZ8MTXP02H3MFA.13.53.E09.1.454.CMB.2.raw
  modified_base (341)..(341): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggcaagtcagaacattggcaactctttaaatggtatcagcagaagtcagggcaacgccccgaactcctgatctacggtacatccactttgcacagtggactccatccaaggttcagtgcagtagntctggaaactagtacttttacccacaccatcgagggtctacagcctagaacgtattttgacgtacttactattgtactaacagtacgttaccttcctaccccggtacgttacggaccgaacggaccgaaagggtagaaactacgaaagacgaactgtacgctcgacacgaagtctgtcttacacttctcccgac

SEQ ID NO: 365056 - DNA, 616 bp, Homo sapiens
  misc_feature: GZ8MTXP02G4KG1.13.53.E09.1.454.CMB.2.raw
  modified_base (343)..(343): a, c, t, g, unknown or other
  modified_base (365)..(365): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacagtggatcccgatccaaggttcagtggcagtantctaggaacagtactttacccncacccatcgaggggtctacagcctagaagtattttgacgtacttactattgtacaactagtacgtttaccttccgtacccccggtacgttcggaccgaaacgggacccgtaaagggttaacgggaaaacttacgaaaacggtaccggaaaaccgttacgggttagggtcctacggtaccgtaaacccgaaacgtttaccgttacgtttacccgtttccgtaaaccgtttacccgttttcccccgtaacccc

SEQ ID NO: 365057 - DNA, 543 bp, Homo sapiens
  misc_feature: GZ8MTXP02IMRKS.13.53.E09.1.454.CMB.2.raw
  modified_base (364)..(364): a, c, t, g, unknown or other
tcagtcacgtactacacgaccggtgctcgatttagagagagtgtgttgggtttgggggcaggagtcagtctcagtcaggacacaacatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggtacatccactttgcacagtggatccatcaagtcagtgcagtgatctaggaacagtactttacccncaccatcgagggtctacagcctagaagtattttgacgtacttacttattagtactaactagtacgtttaacccgttcccgtcccccggtaacgtttcggaccgaagggaaccgtaaggtaggaaactacgtaaagcgtaaacgtgtcggctagcaacactctcgtcttcactcttcccg

SEQ ID NO: 365058 - DNA, 570 bp, Homo sapiens
  misc_feature: GZ8MTXP02HMIGY.13.53.E09.1.454.CMB.2.raw
  modified_base (349)..(349): a, c, t, g, unknown or other
  modified_base (373)..(373): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactcttaaatggtatcagcagaagtcagggcaagcccccgaacctcctgactctacggtacatccactttgcacaggtggatcccatcccaaaggttcaggtggacagtagntctaggaaactagtattttacccncaccatcgaggggtctacagcctagaacgtattttgacgtacttacttattgtacaactagtacgttacccttccgtcccccggtagttccggaccgtaaacgggaccgaaagggtacggaaaactacgaaacgacgtaaacgtggtcggacgtacgaccacctaagtctcgttacttactacttcctttcccgacc

SEQ ID NO: 365059 - DNA, 530 bp, Homo sapiens
  misc_feature: GZ8MTXP02HREOO.13.53.E09.1.454.CMB.2.raw
  modified_base (339)..(339): a, c, t, g, unknown or other
  modified_base (365)..(365): a, c, t, g, unknown or other
  modified_base (521)..(521): a, c, t, g, unknown or other
tcagtcacgtactacacgaccggtgctcgatttagagagagtgtgttcggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggcaagtcagaacattggcaactcttaaatggtatcagcagaagtcagggcaagccccgaactcctgatctacggtacatccactttgcacagtggatccccatcaagttcagtgcngtagatctgaacagtacttttacccncacatcaggggtctacgagcctagaagtatttgcgtactttactattacgttacaactagtacgttaccttccgtacccccggtacgttccggaccgaaacgggacgtaaacggtaggaaagtacaaacgacgaaactgtacgctgcaccatcgtntctctactc

SEQ ID NO: 365060 - DNA, 584 bp, Homo sapiens
  misc_feature: GZ8MTXP02F8JAV.13.53.E09.1.454.CMB.2.raw
  modified_base (343)..(343): a, c, t, g, unknown or other
  modified_base (365)..(365): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatcccatccaaggttcagtggcagtagntctggaaacagtattttacccncaccatcgaggggtctacagccctagaacgtattttgcgtacttactattgtacaaactagtaacgtttaccctttccgtaccccccggtacgtttccggacccgaaacggggaacccgtaaagggtacgggaaaacgttacgaaacggaccgaaaccgttaggtcggaccgttcggccaaccaagttcctgttccttctacttcctttccccgtaccc

SEQ ID NO: 365061 - DNA, 627 bp, Homo sapiens
  misc_feature: GZ8MTXP02GHDFI.13.53.E09.1.454.CMB.2.raw
  modified_base (372)..(372): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggctaactcttaaattggtatcagcagaagtcgagggacaacgcccccgaaacctcctagactcctaacggtacacttccctactttgacacaggtgggactcccccatacgtaaggttcaggtggacagtanatcgtagaactagtacttttacccacactatcgagggtactacgagcctagaagtattagcgtacttactattacgtacaactagtacgttaacccttccgtacccccggtacgttccggaccgtaaacgggaaccgtaaacgggtacggtaaaacgttaccgaaacggtaccggtaaaccgttacggtacggtcgttacggaacccgtaaccgtacgttaccgttcgttacctttaccgtaacgtttacccccg

SEQ ID NO: 365062 - DNA, 572 bp, Homo sapiens
  misc_feature: GZ8MTXP02F7HCE.13.53.E09.1.454.CMB.2.raw
  modified_base (346)..(346): a, c, t, g, unknown or other
  modified_base (370)..(370): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactactttaattggtatcagcagagtcagggcaagccccgaactcctgatctacggtacatcctactttgcacagtgggactcccatccaagttcagtggcagtagntctaggaactagtacttttacccncacctatcgaggggttctaacgacgtcctagaaacgttagttttacgacgttaacttacttattcgtacaactagtacgtttacccttccgtacccccggtagttccggaccgaacggaaccgaaggtacggtaaactacgaaacgacgtacgtaggttcgcgtacgcactaacgtcgtcgtcttactactcctttcccacc

SEQ ID NO: 365063 - DNA, 573 bp, Homo sapiens
  misc_feature: GZ8MTXP02JE3YF.13.53.E09.1.454.CMB.2.raw
  modified_base (343)..(343): a, c, t, g, unknown or other
  modified_base (366)..(366): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacagtggatcccatccaaggttcagtggcagtagntctaggaacagtacttttacccncacccatcgaggggtctacgagcctagaacgtatttgacgtacttactattgtacaaactagtacgtttaccttccgtcccccggtaacgtttccggaccgtaaacggggacccaaagggtaggaaaactacgaaaacggacgaaacgttggtacggtcgttacggctaaccaagtcttcgtacctttcactttccgtttacccgcc

SEQ ID NO: 365064 - DNA, 638 bp, Homo sapiens
  misc_feature: GZ8MTXP02H0B6P.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggactaactctttaaaattggtatcagcagaagtcagggcaagccccgaactcctgatctacggtacatccactttgcacagtggatcccgatccgaaggttcaggtggacaggtagatcgtaggaactagtacttttacccactaccatcgaggggtctacgacgccttagaagtattttagacgttacttaactatttacgtactaaactagtaacgttacccttccgtaccccgggtaacgtttccggaccgaaacgggaacccgtaaaggggtacgaaaacgttacgaaaacggtcggaaaaccgttcggtacgggtaccttacggtacccgaaaccccgtaattaccgttcggtttaccctttccgtaacctttacccttttacccccggtaccccg

SEQ ID NO: 365065 - DNA, 593 bp, Homo sapiens
  misc_feature: GZ8MTXP02J3SGR.13.53.E09.1.454.CMB.2.raw
  modified_base (343)..(343): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggtacatccactttgcacagtggatcccatccaaggttcagtggcagtagntctaggaaccagtactttaccctacaccatcgaggggtctacagcctgaatattttgacgtacttactattgtacaactagtacgttacccttccgtacccccggacgtttaccggacccgaaacggggaaccccgtaaagggtacgggaaaacttaccgaaaacggaccgaaaccgtaggttcgggcctacggaccaacccgtaacgtaccttcggtaccttttcccactttccctttaccccggcccc

SEQ ID NO: 365066 - DNA, 562 bp, Homo sapiens
  misc_feature: GZ8MTXP02GVRW0.13.53.E09.1.454.CMB.2.raw
  modified_base (288)..(288): a, c, t, g, unknown or other
  modified_base (368)..(368): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggacaactctttaaattggtatcagcagaagtcaggcaagccccgaactccngatctacgtacatccatttgcacagtggactcccatccaagtcagtggcagtagatctaggaaactagtacttttacccncaccatcgagggtctaacgacgcctagagtatttgacgtacttactattgtacaactagtacgtttaccttcctacccccggtacgttccggtaccgaaacggaccgaaaggtacggaaaacgtacgaaacgacgaaactacgtacggtacgtcgactaccaacgtctacgttctactactcctttccctaccg

SEQ ID NO: 365067 - DNA, 672 bp, Homo sapiens
  misc_feature: GZ8MTXP02HFVOE.13.53.E09.1.454.CMB.2.raw
  modified_base (388)..(388): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtccaccatcacgttgtcgggcaagtcaagaacattggactaacttctttaaattggtatcagcagaagtcagggcaacgccccgaacctcctagactccgtacggtacactcctactttgacacaggtggactccatccaaggttcagtgacagtagatcgtaggaactagttacttttaccccncaaccctagtacgacgggggttacctaacgacgtacctagtaaacgtagtttttcgacgttactttaacttatttacgtactaaactagtaacgtttacccgttaccccgtacccccgggtaccgttaccggtaccggtaaaccgggtaaccggaaacgggtaacgggtaaaacgttaaccgaaaacggttaaccggaaaccgttaagggtacggtccgtacgaccgtaacccgaacttaccgttccgtttacttaccttacttcccggttttccccgtaaccc

SEQ ID NO: 365068 - DNA, 561 bp, Homo sapiens
  misc_feature: GZ8MTXP02ITZMY.13.53.E09.1.454.CMB.2.raw
  modified_base (287)..(287): a, c, t, g, unknown or other
  modified_base (341)..(341): a, c, t, g, unknown or other
  modified_base (361)..(361): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaacgccccgaactccngatctacgtacatccactttgcacagtggactccatccagttcagtgcagtagntctggaacagtactttaccncactatcgaggggtctacgacgtcctagaacgtattttcgacgtacttacttattgtacaacgtaagtacgtttacccttacccgtcccccggtacgttccggtaccaacgggaccgtaaagggtacggaaatacgaaacgacgaaacgtgtacggctacgccaccgtaatctagtccttacacttaccttcccgtaccc

SEQ ID NO: 365069 - DNA, 583 bp, Homo sapiens
  misc_feature: GZ8MTXP02IKLX1.13.53.E09.1.454.CMB.2.raw
tcagtcacgtactacacgaccggtgctcgatttagagagagtgtgttgggtttgggggagtaagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaactattggactaacttctttaaaatggtatcagacagaagtcaggcaacgccccgaactcctagatctacggtacatcctactttgcacagtggactccatacaaggttcagtgactagtagatcgtaggaaactagttacctttacccacaacctagtacgtagggtacctacacgacctagtaagttatttcgacgttaacttatattacgtacaaactagttacttacccttccgaccccggtacgttacggaccgtaaacgggaccaaaggtacgaaagtaaccgaagacgtacgtagtacggctacgacaacctagtaactcgtacttactactaccgttcctactac

SEQ ID NO: 365070 - DNA, 601 bp, Homo sapiens
  misc_feature: GZ8MTXP02IRP9L.13.53.E09.1.454.CMB.2.raw
  modified_base (245)..(245): a, c, t, g, unknown or other
  modified_base (289)..(289): a, c, t, g, unknown or other
  modified_base (316)..(316): a, c, t, g, unknown or other
  modified_base (320)..(320): a, c, t, g, unknown or other
  modified_base (342)..(342): a, c, t, g, unknown or other
  modified_base (347)..(347): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcggcaagtcagaacattggactaactntttaaaattggtatcagcagaatcagggcaagccccgaactccngatctacggtacatccatttgcacagnggancccatccaaaggttcagtgganagtantcgagaactagttacctttaccacacagtacgtacggtactacacgtacgtagtaattacgtttacgacgttaacttaactattacgtaacaaacgtagttaaccgttacccgtcccgtaccccggtacgtaccggaaccgaaacgggaacgtaaaggtaacgaaaacgtacgaaaacgacggtaaacgtaggtacggtacgtacgacctaactaacgttacgtacgttacttactacttaccttaccgtaccg

SEQ ID NO: 365071 - DNA, 643 bp, Homo sapiens
  misc_feature: GZ8MTXP02IAX9U.13.53.E09.1.454.CMB.2.raw
  modified_base (230)..(230): a, c, t, g, unknown or other
  modified_base (253)..(253): a, c, t, g, unknown or other
tcagtcacgtactacacgaccggtgctcgatttagagagagtgtgttgggtttggggagtcagtctcagtcaggacacagcatggacatgagggtccccgctcaggctcctgggctcctgctactctggctccgaggtgccagatgtgacatccagatgagccagtctccatcccacctgtctgcgtctctcggagacagggtcaccatcacttgcgggcaagtcagaanatgactaactattaattagtatnagacagaagacgaggacgaacgaccccgaacctaccgtacgtactacgtaacgtactactacctactttacgtacacgagtacggtacgtacctactaccgtaacgtacgtagtaggacgtagtagtagtagtacgaacgtacgttaactttacctacctacctactacgtacggtacgtacgtacgtacgtagtaagtagtttacgtacgtacttaacttattacgtactaacgtaacgtaacgttaccttaccgtaccgtaccggtacggtacggtaccggtaacggtaacggtaaacggtaaacggtaaacgtaaacgtaaacgtaacgtaacgtacgtacgtacgtacgtacgaacgtactacgtacgtacttactacttactccg

SEQ ID NO: 365072 - DNA, 563 bp, Homo sapiens
  misc_feature: GZ8MTXP02HF5JN.13.53.E09.1.454.CMB.2.raw
  modified_base (338)..(338): a, c, t, g, unknown or other
  modified_base (364)..(364): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaattggtatcagcagaagtcagggcaagccccgaactctgatctacggtacatccactttgcacagtggatccccatcaagttcagtgcngtagatctagaacagtactttacccncaccatcaggggtctacagcctagaacgtatttgcgtacttacttattgttacaaactagtaacgtttacccttccgtacccccggtacgtttaccggccgaaacgggaccgaaagggttacggaaaagttacgaaacgaccgtaaactcggttaggacgttcgaaccgtacccaatctgttccttctaactttccccg

SEQ ID NO: 365073 - DNA, 580 bp, Homo sapiens
  misc_feature: GZ8MTXP02H41X1.13.53.E09.1.454.CMB.2.raw
  modified_base (344)..(344): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaatctttaaatggtatcagcagaagtcagggcaagccccgaactcctgactctaacggacactcctactttgcacagtgggataccactccaagtcgagtgcagtagntctaggaactagtacttttaccctacacctacgtacgaggggtactacacgaccgtgaaagtattttagacgtacttaacttagttacgtacaaacgtagtacgtttaacccttccgttcccccggtacgtttccggaccgaaacgggaccgaaaggtacggaaaacgtacgaacgacgtacgtacgtcggctcgtacaccaactcgtacgttacttctacttcttaccccgtccg

SEQ ID NO: 365074 - DNA, 582 bp, Homo sapiens
  misc_feature: GZ8MTXP02HQAJS.13.53.E09.1.454.CMB.2.raw
  modified_base (367)..(367): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggtacatccactttgcacagtggatcccatccaaggttcagtggcagttagatctaggaaacagtattttacccnaccatcaggggtctacagcctagaagtattttgcgtacttactattgtacaactagtacgtttacccttccgtcccccggacgtttccggaccgaacgggaccgaacggtaggaaaacgttacgaaaacggacggaaaccttggtacggtcgttacggtaccaaccctaacgttacttacggttccttactactttaccgtttacccccgtaccg

SEQ ID NO: 365075 - DNA, 559 bp, Homo sapiens
  misc_feature: GZ8MTXP02HKV9D.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgtaggtgccagatgtgacatccagatgagccagtctccatccaccctgtctgcgtctctcggagacagggtcaccatcacttgtcggcaagtcagaacattggcaactcttaaattggtatcagcagaagtcaggcaagccccgaactcctgatctacggtacatccactttgcacagtggatcccatccaagttcagtggcagtagatctggaactagtacttttaccctcaaccatcaaggggtctaacgagccctagaagtattttgacgacttactatttgtacaactagacgtttaccctctacccccggtacgttccggaccgtaaacgggaccgtaaacgggtggaaaacgttacgaaacggacgaaacgtcggtacggctcgcaccaagtctacgttctactacttctttcccgacc

SEQ ID NO: 365076 - DNA, 575 bp, Homo sapiens
  misc_feature: GZ8MTXP02FXDKB.13.53.E09.1.454.CMB.2.raw
  modified_base (345)..(345): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaacctcctgatctacggtacatccactttgcacagtggatcccatccaaggttcagtgcagtagntcgaggaaacagtactttacctcaccatcgagggtctacgagcctagacgtatttgcgtaacttacttattgtacaactagtacgtttaccttccgtacccccggtacgttccggtaccgaacggaccgaaacggtaggaaactaacgaaacggacgtaaacgtacggtcgggtactacggactaaccaacgttctcgttacctttcctaactttcccttacccgtcccg

SEQ ID NO: 365077 - DNA, 545 bp, Homo sapiens
  misc_feature: GZ8MTXP02I1E6B.13.53.E09.1.454.CMB.2.raw
  modified_base (285)..(285): a, c, t, g, unknown or other
  modified_base (342)..(342): a, c, t, g, unknown or other
  modified_base (364)..(364): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcaggcaagccccgaactccngatctacggtacatccactttgcacagtggatcccatccaagttcagtgcagttagntctaggaacagtactttacccnaccatctaggggtctacgagcctagagtatttgctacttactattgtacaaactgtacgttaccttccgtacccccggtagttccggaccgaaacgggtacccaagggtacggtaaaactacgaacgacgaaactgtcggtactcgaccacaactctacgtcttcacttccttacccgtcc

SEQ ID NO: 365078 - DNA, 540 bp, Homo sapiens
  misc_feature: GZ8MTXP02GIZ7M.13.53.E09.1.454.CMB.2.raw
  modified_base (372)..(372): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacatgcactcttaatgtatcagcagaagtcagggcaacgccccgaaacctcctgactctacggtacatccactttgcacagtggactccccgatcaagttcagtggcagtagatcgtaggaacctagtacttttacccncaccatcgtaagggtctacacgcctagaagtatttcgacgttaacttctaagttctacaacgaggtacttacccttccgtccccggtacgttcggaccaacgggacccaaggtaggaaactcgaaacgcgaacgtgcggcaggccaccatcctgtctttcactttccc

SEQ ID NO: 365079 - DNA, 512 bp, Homo sapiens
  misc_feature: GZ8MTXP02HRY0Y.13.53.E09.1.454.CMB.2.raw
  modified_base (338)..(338): a, c, t, g, unknown or other
  modified_base (357)..(357): a, c, t, g, unknown or other
tcagtcacgtactacacgaccggtgctcgatttagagagagtgtgttgggtttggggagtcagtctcagtcaggacacagcatggacatgagggtcccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacgtacatccactttgcacagtggatccatccaagttcagtggcagtagntctggaacagatttacccncaccatcagggtctacagcctagagtatttgcgtacttactattgtcaacagtagttaccttctccccggacgttcggccaagggacccaagggtagaaagtcaaaggcgaaacgtgttcgcgtgacaccaatctcgtcttcacttcttcccgcc

SEQ ID NO: 365080 - DNA, 576 bp, Homo sapiens
  misc_feature: GZ8MTXP02FSI3R.13.53.E09.1.454.CMB.2.raw
  modified_base (226)..(226): a, c, t, g, unknown or other
  modified_base (238)..(238): a, c, t, g, unknown or other
  modified_base (417)..(417): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccacctgtctgcgtctctcgggagacagggtcaccatcacgttgtcgggnaagtcagaactnttggcaactcttaaattggtatcagcagaagtcagggcaagccccgaacctccgtgactcctacggtacatccactttgcacagtggactccccaatacaaggttcagtgactagtagatcgtaggaacagtactttaccctacgacctatcgaagggtctacgtacgcctagaacgtntttagcgtaacttactattcgtacaactagagtttacccttcgacccccggtagttcggacccgaaagggtaaccgaaacggtacggaaaactacgaaacgtacgaaactcggtacgtacgttacgaactactaactcgtactactttacactttcccg

SEQ ID NO: 365081 - DNA, 576 bp, Homo sapiens
  misc_feature: GZ8MTXP02JI8VG.13.53.E09.1.454.CMB.2.raw
  modified_base (344)..(344): a, c, t, g, unknown or other
  modified_base (364)..(364): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatcccatccaaggttcagtggcagtagntctggaaacagatttacccncacatcaggggtctacagcctagaagtattttgacgtacttacttattgtacaaacgtagtacgtttacccttaccgtccccccggaacgtttcccgggtaccgaaacgggaacccgaaagggtacggaaaacgtacgaaaacgacgaaaccgtagtcggtacgttcggcaccaacgtcttcggttcttacctacttacctttaccccgtcc

SEQ ID NO: 365082 - DNA, 580 bp, Homo sapiens
  misc_feature: GZ8MTXP02IWO4U.13.53.E09.1.454.CMB.2.raw
  modified_base (285)..(285): a, c, t, g, unknown or other
  modified_base (344)..(344): a, c, t, g, unknown or other
  modified_base (365)..(365): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcaggcaacgcccccgaactccngatctacggtacatccactttgcacaggtggactccatccaaggttcagtggcagtagntcaggaactagtactttaccncaccatcgagggtcacagcctagaactattttgacgtacttactattcgtacaaactagtaccgtttaccttcccgtccccccgggtagtttccggacccgtaaaacggggaccgtaaaacgggtaggaaaacgttacgaaacggtacgtaaaccgtagttacggcgtacgaccaacctaagttcctcgttacttctacttcctttccccgtacc

SEQ ID NO: 365083 - DNA, 604 bp, Homo sapiens
  misc_feature: GZ8MTXP02HZZA4.13.53.E09.1.454.CMB.2.raw
  modified_base (357)..(357): a, c, t, g, unknown or other
  modified_base (381)..(381): a, c, t, g, unknown or other
  modified_base (411)..(411): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggactaactctttaaattggtatcagcagaagtcagggcaagccccgaactcctgactctacggtacactcctactttgacacaggtaggactcccatccgaaggttcaggtggcagtagntcgtaggaactagtactttacccnctacatcgagggtctacgacgctagaagtnttttagacgtactttaactatttgtacaaacgtagtaacgtttaccccgttccgtacccccggtacggttaccggtaccgaaacggggaaccgtaaggggtaacggtaaaacgtacgaaaacggtcgaaaacgttggtaacggtcgtacgaccaacctaatccgttacgttcttactacttcctttcccgacc

SEQ ID NO: 365084 - DNA, 609 bp, Homo sapiens
  misc_feature: GZ8MTXP02I9KZL.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggcaagtcagaacattggcaactcttaaatggtatcagcagaagtcagggcaagccccgaactctgatctacggtacatccactttgcacagtggactccatccaagttcagtggcagtgatcgtaggaacagtactttaccgcaccatcgagggtctacgagtcctagaagtattttcgacgtacttacttaattgttacaaacgtagtacgtttacccgtttacccgtacccccgggtacgtttaccggacccgtaaacggggacccgtaaagggttacggaaaacttacgaaacggacgtaaaccgtggtacggtaccgttcgacccgtaaccgtaacgttccttacggtttccttacctaaccgttaccccgttttacccccgtaccg

SEQ ID NO: 365085 - DNA, 600 bp, Homo sapiens
  misc_feature: GZ8MTXP02GN315.13.53.E09.1.454.CMB.2.raw
  modified_base (341)..(341): a, c, t, g, unknown or other
  modified_base (362)..(362): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactctttaaattggtatcagcagaagtcaggcaagccccgaactcctgatctacggtacatcctactttgcacagtggatccatccaaggttcagtgcagtagntcgaggaacagtactttaccnaccatcgagggtctacagcctagaacgtatttgacgtacttactattgtactaaacgtagtaacgtttaccctttacccgtaccccccggtacgtttaccgggacccgtaaaacggggaccgtaaaacggggtacggaaaacgttaccgtaaaacggaccggtaaaccgtggtaacggtcgttaccgacgacccctaagtccttacgttccttacctacttcccgtttccccgtaccc

SEQ ID NO: 365086 - DNA, 583 bp, Homo sapiens
  misc_feature: GZ8MTXP02HV8R5.13.53.E09.1.454.CMB.2.raw
  modified_base (346)..(346): a, c, t, g, unknown or other
  modified_base (369)..(369): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggacaacgccccgaactcctgactctacggtacatccactttgcacagtggactccatccaagttcagtggcagtangtctagaactagtactttacccnaccatacgagggtctacgagcctagtaagttattttcggcttaacttacttatttacgtactaaactagttacgtttacccttacccgttaccccggtacgttccggacccgtaaaggggaacccgtaaagggttaacggaaaagttacaaaacggacgtaaacgtggtacgcgtacgcacaacgttctcgttcttctacttccgtttcccgac

SEQ ID NO: 365087 - DNA, 601 bp, Homo sapiens
  misc_feature: GZ8MTXP02GFAFQ.13.53.E09.1.454.CMB.2.raw
  modified_base (344)..(344): a, c, t, g, unknown or other
  modified_base (348)..(348): a, c, t, g, unknown or other
  modified_base (371)..(371): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaaacctcctgatctacggtacatccactttgcacagtggatcccccatcaagttcagtgcngtanatctggaacagtacttttacccncaccatcaggggtctaacagcctagaagtattttgacgtaactttactatttgtacaaactagtacgttaacccttccgtacccccggtacgtttccggacccgtaaacggggaacccgtaaaagggttacggaaaacgttacgaaaacggtaccggaaaaccgttcggttacggcgttacggaaccgtaacccgaagttaccttagttacctttccgtaactttccccg

SEQ ID NO: 365088 - DNA, 585 bp, Homo sapiens
  misc_feature: GZ8MTXP02I4YLX.13.53.E09.1.454.CMB.2.raw
  modified_base (360)..(360): a, c, t, g, unknown or other
  modified_base (386)..(386): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaacttacttaaattggtatcagcagaagtcgagggcaacgcccccgaacctcctgactctacggtacactcctactttcgcacgagtggactccatacccgtaggttcagtcggctagtagntacgtaggtaactagtactttacccnctaccatcgacgggtactacgagtccgtagaagtattttcgacgttacttactagttcgtactaacgtagtaccgtttaccttacccgtacccccggtagttaccggaccgtaacggaccgaagggtacgaaactacgtaacgacgaactggtacggtctacgccacaacgtcttcgtcttacctacttccttcccgac

SEQ ID NO: 365089 - DNA, 552 bp, Homo sapiens
  misc_feature: GZ8MTXP02I36XU.13.53.E09.1.454.CMB.2.raw
  modified_base (341)..(341): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcaggcaagccccgaactcctgatctacggtacatccactttgcacagtggatcccatccaagttcagtggcagtantctggaacagtacttttaccactaccatcgaggggtctaacgacgcctagagtattttgacgtacttactatttgtacaactagtacgttacccttccgtacccccggtagtttccggaccgaaacgggaccgaaaggtacggaaactacgaacgacgaactaggtacggctacgcgaccaagtactcggttcttacacttccttaccgcc

SEQ ID NO: 365090 - DNA, 604 bp, Homo sapiens
  misc_feature: GZ8MTXP02F1OJ4.13.53.E09.1.454.CMB.2.raw
  modified_base (237)..(237): a, c, t, g, unknown or other
  modified_base (374)..(374): a, c, t, g, unknown or other
  modified_base (406)..(406): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacnttggcaacttcttaaattggtatcagcagaagtcgaggcaagccccgaactcctgatctacggtacatccactttgcacagtggactcccccatcaagttcagtggcagtagatcgtaggaactagtactttacccncacctagtcgagggtctacgagcctagaagtntttacgcgttaacttactattcgtacaacagtacgtttaacccttcccgtaccccggtacgttaccggtacccgaaacggggaccctaaaagggttacggaaaacgttaccgaaacggtacggtaaaccgttaggtacggtccgttacggaacctaacccgtacttcccgttacgtttccttacctactttacccccg

SEQ ID NO: 365091 - DNA, 574 bp, Homo sapiens
  misc_feature: GZ8MTXP02GTJHJ.13.53.E09.1.454.CMB.2.raw
  modified_base (349)..(349): a, c, t, g, unknown or other
  modified_base (372)..(372): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggactccccataccaaggttcagtggcagtagntctaggaactagtactttacccncaccatcgaggggtctacgacgtcctagaagtattttcgaccgtactttacttattcgtaccaaacgtagtacgtttacccttcccgtaccccccgggtacggtttccggaccggtaaacgggaccaaagggtacggaaaactacgaagacgaaacgtgtcggactcgcacctaatctagtccttacacttccgttcctccc

SEQ ID NO: 365092 - DNA, 545 bp, Homo sapiens
  misc_feature: GZ8MTXP02HXUBC.13.53.E09.1.454.CMB.2.raw
  modified_base (338)..(338): a, c, t, g, unknown or other
  modified_base (342)..(342): a, c, t, g, unknown or other
  modified_base (363)..(363): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagagtcagggcaagccccgaactcctgatctacggtacatccactttgcacagtggatccccatcaagttcagtgcngtanatctggaacagtatttacccncacatcagggtctacgagcctagaagtattttgacgtatttactattgtactaacagtacgttacctcctcccccgggtacgttcggtaccgaacgggtacccgaaggtacggtaaagtacgaaacgacggtaactgttacggctacgaacgacctaactcttcgtctttacctactttccc

SEQ ID NO: 365093 - DNA, 548 bp, Homo sapiens
  misc_feature: GZ8MTXP02FZWHC.13.53.E09.1.454.CMB.2.raw
  modified_base (347)..(347): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaacctcctgatctaacggtacatccactttgcacagtggatcccatccaagttcagtggcagtagntctaggaaacagtacttttacccncaccatcgaggggtctaacagcctagaagtattttcgacgtaacttacttattcgtacaaactagtacgtttaacccttccgtacccccggtagttccggaccgtaaacgggaccgaaaggtacgaaagtacaagacgaacgtgtacggctacgcacaatctctctcactctccgtc

SEQ ID NO: 365094 - DNA, 582 bp, Homo sapiens
  misc_feature: GZ8MTXP02GRRRO.13.53.E09.1.454.CMB.2.raw
  modified_base (358)..(358): a, c, t, g, unknown or other
  modified_base (382)..(382): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtccaccatcacttgcggcaagtcagaacattggacaacttctttaaattggtatcagcagaagtcagggcaacgccccgaacctcctgactctacggtacatcctactttgcacgtaggtcggactcccatccgtaaggttcagtggacagtagntcgtaggaactagtactttacccncacctagtcgagggtctacgacgtcctagaagtattttcgacgtacttacttattcgtacaacgtagtacgtttacccttccgtacccccggtagttccggaccgaaacggtaccgaaggtacgaaacgtacgaacgacgtaacgtcgacggtctacgacactaactcttacgttcttactaccttccgttacccgtacc

SEQ ID NO: 365095 - DNA, 572 bp, Homo sapiens
  misc_feature: GZ8MTXP02HTBQM.13.53.E09.1.454.CMB.2.raw
  modified_base (369)..(369): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcagggcaagccccgaaacctcctgatctacggtacatccactttgcacagtggatccccatcaagttcagtgcagtagatctaggaacagtacttttacccncaaccatacgaggggtctaacgacgcctagtaagtatttgacgtactttacttattgtacaactagtacttaaccttccgtacccccggtacgttccggaccgaaacgggaacccgaaaggtacggaaaacgttacgaaacgacggtaaaacgtcgtcggtacttggaaccgacgtaactcttagtccttactactttccccg

SEQ ID NO: 365096 - DNA, 579 bp, Homo sapiens
  misc_feature: GZ8MTXP02HU6KX.13.53.E09.1.454.CMB.2.raw
  modified_base (345)..(345): a, c, t, g, unknown or other
  modified_base (366)..(366): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaactcctgactctacggtacatccactttgcacagtggactccatccaagttcagtggcagtagntctgaaacagtactttacccncaaccatacgagggtactacgagtcctagaagtatttggactacttactatttcgtactaaacgtagtaaccgtttacccttccctacccccgggacgttaccggaccgaaacggggtaccctaaagggtacggaaaactcgaaaacggtacgaaacgtgttacggctacggaccaaccaattctacgttcttacacttccctttacccgacc

SEQ ID NO: 365097 - DNA, 607 bp, Homo sapiens
  misc_feature: GZ8MTXP02IBVOP.13.53.E09.1.454.CMB.2.raw
  modified_base (312)..(312): a, c, t, g, unknown or other
  modified_base (446)..(446): a, c, t, g, unknown or other
  modified_base (547)..(547): a, c, t, g, unknown or other
  modified_base (578)..(578): a, c, t, g, unknown or other
  modified_base (583)..(583): a, c, t, g, unknown or other
  modified_base (606)..(606): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacgttgtcgggcaagtcaagaacattggactaactctttaaattggtatcagcagaagtcgagggacaacgtaccccgaactcctagactctacggtacnctacctaactttgacgtacaggttcggggaactccccaagttaccgtaaacggtttccgaaggtcggactagttagacttccgtaaggaaacctagttaccttttacccactacccagtacgacgggtctaacncgctagtagttatttgacttacttatattacgtaccaatagtacttacccttcccgtccccggtagttccgacgaaacgggaccgaaaggtaggaaactanaagacggaaacttgggacgtacgcaccaacncttcncgttctctacttccgtttacccnc

SEQ ID NO: 365098 - DNA, 545 bp, Homo sapiens
  misc_feature: GZ8MTXP02HO77F.13.53.E09.1.454.CMB.2.raw
  modified_base (344)..(344): a, c, t, g, unknown or other
  modified_base (371)..(371): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcaggcaagccccgaaaacctcctgatctacggtacatccactttgcacagtggatccccatcaagttcagtggcngtagatctaggaacagtactttacccnctaccatcaggggtctacagcctgaagtatttagcgtacttactattcgttacaacagtacgttaaccttccgtacccccggtacgttcggaccgtaacgggacgaacggtaggaaaacgtacgaaacgacgaaacctcgtaggtcgtgaacacactccttcgtctactactcc

SEQ ID NO: 365099 - DNA, 584 bp, Homo sapiens
  misc_feature: GZ8MTXP02G07XB.13.53.E09.1.454.CMB.2.raw
  modified_base (319)..(319): a, c, t, g, unknown or other
  modified_base (349)..(349): a, c, t, g, unknown or other
  modified_base (370)..(370): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggacaacgccccgaacctcctgactctacggtacactccactttgcacngtggatcccatccaaggtcagtgcagtagntctaggaacagtactttaccncaccatcgagggtcacagcctagagtatttgactacttacttattgtacaacgtagtacgtttacccgttccgtacccccggtacgtttccggaccgtaaacgggaccgtaaagggtacggtaaaacgtacgaaacggtacgaaacgttacggtacggtccgtacgaccgacctaacttcgtacgttcttacctactccctttacccgtacccg

SEQ ID NO: 365100 - DNA, 614 bp, Homo sapiens
  misc_feature: GZ8MTXP02HPRWT.13.53.E09.1.454.CMB.2.raw
  modified_base (343)..(343): a, c, t, g, unknown or other
  modified_base (365)..(365): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggcaagccccgaacctcctgatctacggtacatccatttgcacagtggatcccatccaaggttcagtgcagtagntctaggaacagtactttacccncaccatcgagggtctacgagtcctagtaagtatttgacgtacttactattcgtacaaactagtacgtttacccgttaccgtcccccgggtacgtttccggaccgtaaacggggaccgaaacgggtacggaaaacgttacgaaaacggtaccggtaaaaccgttggttacgggaccgttcggtacccgaaccctaacggttccttaccggttcctttacccgtaccgtttaccctttcccccggtaaccc

SEQ ID NO: 365101 - DNA, 535 bp, Homo sapiens
  misc_feature: GZ8MTXP02JVXAW.13.53.E09.1.454.CMB.2.raw
  modified_base (344)..(344): a, c, t, g, unknown or other
  modified_base (348)..(348): a, c, t, g, unknown or other
  modified_base (369)..(369): a, c, t, g, unknown or other
  modified_base (521)..(521): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaacgccccgaacctcctgatctacggtacatccactttgcacagtggactccccatcaagttcagtgcngtanatcagaacagtactttacccncaccatcgagggtctacgagcctagaacgtatttgaccgtacttactattgtacaacagtacgttaccttccgtacccccggtacgtccgaccgaacggaccgaaggtacggaaactacgaacgacgacgtcgtcggtctgcgacactcgtntcttactacttccc

SEQ ID NO: 365102 - DNA, 555 bp, Homo sapiens
  misc_feature: GZ8MTXP02GSG4G.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggcaacgccccgaacctcctgatcctacggtacactcccactttgcacagtgggactccccatcaaggttcagtggcagtagatcgtagaactagtacttttacccacacctatcaggtcgtactacgacgtacgtagtattacgtcgtacttacttattagttactaactaagtacgtaccttaccgttcccgtacccggttacgaccgtacggacgaacggtaagaacgtagaacgacgacgtacgtcggtacgtcgcgacaactctctctcttactcccg

SEQ ID NO: 365103 - DNA, 622 bp, Homo sapiens
  misc_feature: GZ8MTXP02HJHLH.13.53.E09.1.454.CMB.2.raw
  modified_base (320)..(320): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccacctgtctgcgtctcgtcggagacgagggtcaccatcacttggtcggcaagtcaagaactagttggactaacttcttaaattggtatcagcgagagtcggaggacaccgaccccgtactcgtatctacgtacgtacactaccttnttcgacagaggtacgtacctactacgtaccgtaacgttcgaggtacgacgagtatcgtacgaagaacgtactttacctttacccactacagtcgggtaacgtcagacgtctaagtagtttacgttcggacttacttattagtttcgaaactacgtaacggttaaccctttcccgaccccggtcccgtttacggaccgacgaaacgggtaccgtaagggtacaaacgtacgacggtaccagttacggcggtaccacgtacctataaccgttcgttctacctaccttccctacccgtacctacg

SEQ ID NO: 365104 - DNA, 567 bp, Homo sapiens
  misc_feature: GZ8MTXP02JCGML.13.53.E09.1.454.CMB.2.raw
  modified_base (313)..(313): a, c, t, g, unknown or other
  modified_base (341)..(341): a, c, t, g, unknown or other
  modified_base (345)..(345): a, c, t, g, unknown or other
  modified_base (367)..(367): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagagtcaggcaagccccgaacctctgatctacggtacatcccactttgcanagtgggatcccccatcaagttcagtgcngtanatctggaacagtactttacccncaccatcaggggtctacgagcctagaacgtatttcgcgtacttactattcgtacaactagtacttaccgttcctacccccgggtacgttccggaccgaacgggaccgtaacgggtacggtaaaacgtacgaaacgtaccgaaaaccgtggtacgggtctacggctaaaccggcttaccgtcgttcctttacactttcccc

SEQ ID NO: 365105 - DNA, 551 bp, Homo sapiens
  misc_feature: GZ8MTXP02F2DKE.13.53.E09.1.454.CMB.2.raw
  modified_base (317)..(317): a, c, t, g, unknown or other
  modified_base (346)..(346): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggacaacgccccgaactcctagatctacgtacactccattgcacngtcggatcccccatccaagttcagtgacngtagatcgtagaactagtactttacccacacctatcgagggtctacgacgcctagaagtatttcgacgtacttactattcgtacaactagtactttacccttccgtacccccggtacgtcgaccgtaacgggacgtaaggtacgtaaacgtacgaaacgacgtaaacgtggtacgctacgcactactctcgtctctactttcccg

SEQ ID NO: 365106 - DNA, 615 bp, Homo sapiens
  misc_feature: GZ8MTXP02G9C02.13.53.E09.1.454.CMB.2.raw
  modified_base (314)..(314): a, c, t, g, unknown or other
  modified_base (343)..(343): a, c, t, g, unknown or other
  modified_base (371)..(371): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggcaactcttaaatggtatcagcagaagtcagggcaagccccgaactcctgatctacggtacatcccactttgcanagtggatcccccatcaaggttcagtggcngtagatctaggaacagtacttttacccncaccatcaggggtctacagcctagaagtatttgcgtaactttactaattcgtacaaactagtacgtttaacccttccgtacccccgggtacgtttccgggacccgtaaacggggacccgtaaaacggggttagggaaaacttacggaaaacggtacggaaaacccgtttagggacgggtaccttcggaacccgaacccgtaaacgtttaccttacggttacccttttccgaacgttttcccccg

SEQ ID NO: 365107 - DNA, 550 bp, Homo sapiens
  misc_feature: GZ8MTXP02I461N.13.53.E09.1.454.CMB.2.raw
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatcccatccaaggttcagtggcagtagatctggaaacagtacttttacccncacccatcgaggggtctaacgagcctagaagtattttggactacttaactatttcgtacaaactagtacgtttaacccttcctacccccggtagttccggaccgaaagggacccgaaagggtaggaaaacgtacaaacgacgaactagtcgcgtcgcaccaagtctcgtctcactcttcctcc

SEQ ID NO: 365108 - DNA, 582 bp, Homo sapiens
  misc_feature: GZ8MTXP02GMSMQ.13.53.E09.1.454.CMB.2.raw
  modified_base (343)..(343): a, c, t, g, unknown or other
  modified_base (364)..(364): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaacgccccgaactcctgatctacggtacatccactttgcacagtggatcccatccaagttcagtggcagtagntcaggaacagtactttacccncaccatcgagggtctacgagcctagaacgtatttgacgtacttactattgtacaactagtacgtttaccttccgtacccccggtagttccggaccgtaaacgggaacccgtaaaggggtacgtaaaacttacgaaaacgtaccgaaacgttaggtacggtcgttacggaccaaccgaacgttactacgttcctttacacttccctttccccggtaccc

SEQ ID NO: 365109 - DNA, 761 bp, Homo sapiens
  misc_feature: GZ8MTXP02GB264.13.53.E09.1.454.CMB.2.raw
tcagtcacgtactacacgaccggtgctcgatttagagagagtgtgttgggtttgggggagtcagtctcagtcgaggacacagcatggacatggacgggtccccgctcagctccgtggggctcctgctactctggctccgaggtgccagatgtgacatccagatgagccagtctccatcccaccctgtctgcgtctcgtcggagacgagggtcaccatcacttggtcgggacaagtcagaactagttggacaacttactttaaattggtatcagcagagtcgaggacaacgccccgaacctcgtgactcgtacggtacacgtcctactttcgacacgtagtagggactcccataccgtaagttcaggtcgacgagtagctcgtaggaactagttacctttttacccactaaccctagtacggtacggggttacctaacgacgtacccgtagtaaacgttagtttttacgaccgttaaactttacctttaaagtttacgtaaccgtaaaacgtaggtttaacccgttttaacccccgtttaccccggttaccccccccggggttaaccggtttacccggggaaccccggtaaaaccgggggtaaaccccggtaaaacggggttaaacgggtaaaacgttaaccggaaaacggtaccggtaaacgttaacgggtcggtacgttaccggaccgtaaccctaaacggttacccttcggtttacccgtttaccgtaacctttacccggttcccccgtttaaaccccg

SEQ ID NO: 365110 - DNA, 593 bp, Homo sapiens
  misc_feature: GZ8MTXP02HSRFO.13.53.E09.1.454.CMB.2.raw
  modified_base (201)..(201): a, c, t, g, unknown or other
  modified_base (350)..(350): a, c, t, g, unknown or other
  modified_base (382)..(382): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggcaagtcagaacattggcaactcttaaatggtatcagcagaagtcagggcaacgccccgaaacctcctgactctaacggtacactccactttgcacagtggactccccatacaaggttcagtcggnagtagatctaggaactacgtacttttaccccnctactagtacgacgggtctaacgagacctagaagtattttgacgtactttactattacgtacaactagtactttacccttacccgtccccggtacgttcggaaccgtaacgggaaccgtaaagggtacggtaaaactcggaaacgaacggtacgtacggtcggtacgtacggaaccacgtaacttactacgttcctttactaacgttcccg

SEQ ID NO: 365111 - DNA, 559 bp, Homo sapiens
  misc_feature: GZ8MTXP02F4IC2.13.53.E09.1.454.CMB.2.raw
  modified_base (343)..(343): a, c, t, g, unknown or other
  modified_base (346)..(346): a, c, t, g, unknown or other
  modified_base (364)..(364): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatcccatccaagttcagtgcagtagntcnggaacagtactttacccncaccatcgaggggtctacagcctagaagtattttgcgtacttactattgtacaacagtacgttaccttccgtacccccggtacgttccggaccgaacgggacccgtaaggtacggaaaactacgaaacgacgtaaaccgtagttacggacctacgccgaaccaagttctacgttcttctacttcctacccgtccc

SEQ ID NO: 365112 - DNA, 554 bp, Homo sapiens
  misc_feature: GZ8MTXP02HR20F.13.53.E09.1.454.CMB.2.raw
  modified_base (349)..(349): a, c, t, g, unknown or other
  modified_base (370)..(370): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagcccccgaactcctgactctaacggtacatccactttgcacagtcgggatcccatcccaaaggttcagtggcagtagntctaggaacagtatttacccnacccatcaggggtctacgagcctagaacgtattttgcgtacttactattgtacaactagtacgtttaccttccgtaccccggtacgttcggaccgtaacggaacgtaggtaacgtaaacgtacaacgacgaaacgtagacggtcgtacgcactaacgtactcgttactctactctttccctacc

SEQ ID NO: 365113 - DNA, 575 bp, Homo sapiens
  misc_feature: GZ8MTXP02IEWFK.13.53.E09.1.454.CMB.2.raw
  modified_base (348)..(348): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcaggcaacgccccgaactcctgactctacggtacatccactttgcacagtggactcccataccaaggttcaggtggcagtagntcgtaggaaactagtacttttacccactacccatcgaggggtctacgacgcctagaagtattttacgacgttacttaactattcgtacaaacgtacgtacgtttacccttcccgtacccccggacgttccggaccgaacgggaaccgtaacgacgtaggacgactacgaaacgacgtaacgtacgtcggacgtcgaaccaccgacttctcgttcttactacttcccg

SEQ ID NO: 365114 - DNA, 568 bp, Homo sapiens
  misc_feature: GZ8MTXP02JN892.13.53.E09.1.454.CMB.2.raw
  modified_base (373)..(373): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctaatctggctccgaggtgccagatgtgacatccagatgagccagtctccatccaccctgtctgcgtctctcggagacagggtcaccatcacttgtcgggcaagtcagaacattggcaactcttaaatggtatcagcagagtcagggcaagcccccgaactcctgactctacggtacatccctactttgcacaggtggactcccatccaaggttcagtggcagtagatctaggaaacagtacttttaccccncaccatcgaggggtctacgagtcctagaacgtattttgcgtacttacttattcgtacaacgtagtacgtttaccctccgtcccccggtagttccggacgtaaacgggaccaagggtaggaaaactcgaagacgtaaacgtggtcggactcgccaaccgtaactcgttacgtcttcctaacttccgtttcccgacc

SEQ ID NO: 365115 - DNA, 588 bp, Homo sapiens
  misc_feature: GZ8MTXP02IH5OG.13.53.E09.1.454.CMB.2.raw
  modified_base (347)..(347): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaattggtatcagcagaagtcagggacaacgaccccgaacctcctgactctacggtacatccactttgcacagtggatccatccgaagttcagtgacagtagntctaggaacagtactttacccacaccatcgacgggtctacagccgtagtaagtatttgacgtacttactattacgtactaaacgtagtacgtttaccctccgtacccccggtacgttccggaaccgtaacgggaaccgtaacggtaacgtaaacgtacgtaaacggacgtaaccgtaggtacggtacgtcgtacacccgtaacgtactacgttccttactaccttacccgtttcccgtacc

SEQ ID NO: 365116 - DNA, 627 bp, Homo sapiens
  misc_feature: GZ8MTXP02JXIHX.13.53.E09.1.454.CMB.2.raw
  modified_base (349)..(349): a, c, t, g, unknown or other
  modified_base (373)..(373): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggcaactctttaaattggtatcagcagaagtcgaggcaacgccccgaactcctgactcgtacggtacatccactttgacacagtggactccatccgaagtcagtggcagtagntcgtaggaacagtacttttacccnctacccagtcgagggtactacgagtccctagtaacgtagttttgaccgtactttactattagtactaacgagtacgtttaccttccgtacccccggacgtttacgggacccgtaaagggaaccgtaaacgggtaggtaaaacgttacgaaaacgggtacgaaaacggttcggtacgggaccgttacggacctaaccgtaacgttccgttacggttcctttaccgtaccgtttccccgttacccccgttaacccg

SEQ ID NO: 365117 - DNA, 547 bp, Homo sapiens
  misc_feature: GZ8MTXP02ID6YF.13.53.E09.1.454.CMB.2.raw
  modified_base (355)..(355): a, c, t, g, unknown or other
  modified_base (380)..(380): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaacgccccgaactcctagatactacggtacactccactttgacacagtgggactcccatcccgtaaaggttcagtggcagtagntctaggaaactagtacttttacccncacatacaggggtctacgacgcctagaagtattttagacgtacttactattgtactaacagtacttaccgttcctccccggtacgttccgacgaacggaccgaaacggtagaaagtacgaagacgaactagacgcgcgacaccaatctactctactctcttcccgac

SEQ ID NO: 365118 - DNA, 570 bp, Homo sapiens
  misc_feature: GZ8MTXP02JESIP.13.53.E09.1.454.CMB.2.raw
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactttggctccgaggtgccagatgtgacatccagatgagccagtctccatccaccctgtctgcgtctctcggagacagggtcaccatcacttgtcgggcaagtcagaacattggcaactctttaaaattggtatcagcagaagtcagggcaagccccgaacctcctgatctacggtacatccactttgcacagtgggatcccatcaagttcagtgcagtagatctaggaacagtactttacccncacatcaggggtctacgagcctgaacgtattttgacgtactttactatttgtacaaactagtacgttacccttccgtacccccggtacgttaccgccgaaacgggacccgaagggttacggaaaactacgaaacgtaccgaaacgtcggtacggtacgtcgccaacctactcgtacttacttctactcccttcccgacctacg

SEQ ID NO: 365119 - DNA, 577 bp, Homo sapiens
  misc_feature: GZ8MTXP02HVGK5.13.53.E09.1.454.CMB.2.raw
  modified_base (344)..(344): a, c, t, g, unknown or other
  modified_base (366)..(366): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctctgatctacggtacatccatttgcacagtggactccatccaaggttcagtggcagtagntctggaaactgtattttacccncaccatcgagggtctacgagcctagaagtatttgacgtacttactatttcgtacaaactagtacgtttacccttcccgtacccccggacgtttccggaccgaaacgggtacccgaaacgggtaggaaaactaccgaaaagtacgaaaccgtggttaacggcgtacggaccacctaacgttctcgtttccttactacttcctttccccgacc

SEQ ID NO: 365120 - DNA, 597 bp, Homo sapiens
  misc_feature: GZ8MTXP02GU35U.13.53.E09.1.454.CMB.2.raw
  modified_base (348)..(348): a, c, t, g, unknown or other
  modified_base (371)..(371): a, c, t, g, unknown or other
  modified_base (400)..(400): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaactcctgatctacggtacatccactttgcacagtgggatcccgatccgaagttcagtggcagtagntctaggaactagtactttacccncaccatcgagggtctacagcctagaagtntttcgacgtacttactattgtacaactagtacttacccttcctacccccggtacgttccggaccgaaacgggacctaaacgggtaggaaaacgtacgaaaacggtaccgaaacgttaggttacggaccgttcggacccgtaaccgtaacttaccgttacgttacctttcctaaccttaccctttaccccggtacccc

SEQ ID NO: 365121 - DNA, 626 bp, Homo sapiens
  misc_feature: GZ8MTXP02HB60M.13.53.E09.1.454.CMB.2.raw
  modified_base (378)..(378): a, c, t, g, unknown or other
  modified_base (441)..(441): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacgagggtccaccatcacgttggtcgggacaagtcaagaactattacggactaaacttactttaaattggtatcgagcaagaagtcgagggacaacgacccccgaactcctgactctacggtacactcctactttgacacgagtaggactaccataccgtaaggttcagtgactagtagntcgtaggaaactacgttactttacccactacatacgacgggtactacgagtcctagaacgttntttacgacttacttactagttataactaacgtagtacctttacccgttcccgtacccccggtacgttaccggaccgtaaacgggaaccgtaaagggtaacggaaaactacgaaacggaccgtaaaacgtggttacggcttacgaccaacctaagttcgttcgtactctaccgttcctcccgtacc

SEQ ID NO: 365122 - DNA, 618 bp, Homo sapiens
  misc_feature: GZ8MTXP02GYJLJ.13.53.E09.1.454.CMB.2.raw
  modified_base (347)..(347): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgactctacggtacatccactttgcacagtggactcccatccaaggttcagtggcagtagntcgtaggaactagtacttttacccactaccatcgaggggtctacgacgcctagaagtattttcgacgtacttactattgtacaactagtacgtttaccttccgtacccccggtacgttccggaccgtaaacgggaaccgaaagggtacggaaaacgttacgaaaacggtaccggtaaaccgttaggtacgggtaccgttacggacctaacccgtaacttccgttaacggtttcctttaccgtaactttccccgtttccccggttaaccccg

SEQ ID NO: 365123 - DNA, 584 bp, Homo sapiens
  misc_feature: GZ8MTXP02IY7HH.13.53.E09.1.454.CMB.2.raw
  modified_base (345)..(345): a, c, t, g, unknown or other
  modified_base (368)..(368): a, c, t, g, unknown or other
  modified_base (534)..(534): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagcccccgaactcctgatctacggtacatccactttcgcacagtggactccatccaaggttcagtggcagtantctaggaaacagtactttacccncacccatcgagggtctacgagacctgtaagtatttgacgtacttactattgtacaactagtacgtttaccttccgtacccccggtagttaccggacccgtaaacggggtaacccgaaagggttacggaaaactacgaaagtaccggtaaaacgtggtacgggtccncggtaccaacctaattaccgtcgttccttacacttaccctttaccgtccc

SEQ ID NO: 365124 - DNA, 554 bp, Homo sapiens
  misc_feature: GZ8MTXP02IGHZU.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcaggcaagccccgaactcctgatctacggtacatccactttgcacagtggactccatccaagttcagtgcagtagatcgtaggaactagtacttttaccactaccatcgaggggtctacgagcctagaacgtatttgcgtacttacttattagtacaactagtacgtttaccttactcccgacggtacgttacgtaccgaacggacgaaggtaggaaactacgtaaggacgaacgtacgtacggactcgacaactactactcgttacttcctacttcctttaccccg

SEQ ID NO: 365125 - DNA, 647 bp, Homo sapiens
  misc_feature: GZ8MTXP02I3UXH.13.53.E09.1.454.CMB.2.raw
  modified_base (359)..(359): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggcaagtcaagaactattggactaacttactttaaattggtatcagcagaagtcagggcaacgccccaactctgactctacggtacactacctactttgcacaggtggactccccatcgaaggttcagtcgcagtanatcgtaggaactacgtacttttacccactacctataccgacggggttacctaacgtacgtacctaaggtaacgttagttttacgaccgttaaacttactttaatttacgttacgtaaacgtacggttaccgtttaaccccgttcccgttacccccgggtaacggtttccgggaaccgtaaacgggtaacgtaaacggtaacggtaaaacgtacgaaacggtacgaacgttcgtacggtacgttacgaaccgtactacgttacgtcgttacctttactacgtttccccg

SEQ ID NO: 365126 - DNA, 632 bp, Homo sapiens
  misc_feature: GZ8MTXP02H7HGD.13.53.E09.1.454.CMB.2.raw
  modified_base (389)..(389): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacgagggtccaccatctacttggtcgggacaagtcaagtaactagttggactaacttactttaaagttggtatcgagcagagtcgagggcaacgccccgaactcctgtactcgtaaccggtacactacctactttcgactacgtacggtaggacctcctataccgtaaggttccaggtcggacagtagntcgtagaactagtactttaccactaccagtacggagggtactacgacgaccttaggtaacgttacgtttacgaccgttacttactagtttacgtacaacgttagttaccgtttaaccttcccggtaccccggtacgttccggaccgaacgggtacccgaaggtacggaaaactcgaacggactaacgtcggacgtacgacgtacaccgtaagttctacgttcttactccgttcctttacccgc

SEQ ID NO: 365127 - DNA, 587 bp, Homo sapiens
  misc_feature: GZ8MTXP02JL3OQ.13.53.E09.1.454.CMB.2.raw
  modified_base (201)..(201): a, c, t, g, unknown or other
  modified_base (378)..(378): a, c, t, g, unknown or other
  modified_base (572)..(572): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggcaagtcaagaacattggacaaacttcttaaattggtatcagcagaagtcgagggcaacgccccgaactcctgactctacggtacatcctacttgcacagtcggatccccatcaaggttcagtggcagtagatcgagaactagtactttacccncacctatcgagggtctacgagtcctagaacgtatttcgaccgtaactttacgttattacgtacaaactacggtaacgtttacccttaccgtacccccgggtacgtttccggtacccgaaacgggaaccgtaaacggtaacggtaaaatacgaaacgacgaaacgtcggtacggtcctgaaccgaccaactcgtntcttactacttcccg

SEQ ID NO: 365128 - DNA, 790 bp, Homo sapiens
  misc_feature: GZ8MTXP02HTCVJ.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacgagggtccaccatcacttggtcgggacaagtcaagaactagttggactaacttactttaaagttggtatcgagacaagtaagtcgacgggaccaacggacccccgaacctccgtagactacgtaacggtactactaccctactttgacctacgtaggtacgggtacctacccgtaattacccgtaaaggtttacaggtcgggtacgtaaggtagtacgttaccggtaaggtaaacctacgtttaacctttttaaccccacctaacccgtagttaccggtacggggttacctaacgacgttacccgttaggtaaacgtttagttttacggtacttaaacgtttaacttagttttataaaccgtaaacgttaacggttaccgtttaccccgttacccccggttacccccgggtaacggttacccgggtaacccggaaacggggtaaacccgtaaacggggtaacggtaaaaacgttccggaaaaacggtccggtaaaacgttcgggtacggtacccgtacggaccctaaccgtaacgttacccggttcgtttacccttcgtttaacccgttcccctttaccccggtaacccg

SEQ ID NO: 365129 - DNA, 588 bp, Homo sapiens
  misc_feature: GZ8MTXP02INVG2.13.53.E09.1.454.CMB.2.raw
  modified_base (198)..(198): a, c, t, g, unknown or other
  modified_base (361)..(361): a, c, t, g, unknown or other
tcagtcacgtactacacgaccggtgctcgatttagagagagtgtgttgggtttgggggagtcgagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcggcaagtcagaacattggactaactcttaaattggtatcagcagaagtcgaggcaacgccccgaactcctagactctacggtacactccgactttgcaacaggtggtactcccatccgtaaaggttcaggtggacaggtacngtctagggaaacagttaacttttaccccaactaccactcgaacggggtctacgacgtcctagtaagtacttttgacgtacttacttattacgtacaaatacggtacttaccttacccgtccccggtacgttccgacgtaacgggacctaagggtacgaaagtacgaagacgaactaggcgtacgtcgactacgaacgttctacgttctactacttaccgttcctacc

SEQ ID NO: 365130 - DNA, 566 bp, Homo sapiens
  misc_feature: GZ8MTXP02F0Q7A.13.53.E09.1.454.CMB.2.raw
  modified_base (360)..(360): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaacttctttaaattggtatcagcagaagtcagggcaacgccccgaactcctgactctacggtacactccactttgcacgagtgggactccccgatccgaaaggtttcaaggtcggcagtagntctagggaaactagtacttttacccacaccatcgaggggtctacgagctagagtatttgacgtacttacttattagtacaactagtactttacccttccgtacccccggtacgttccggaccgaacgggaccgaaaggtacgaaacgtacgaacgacgaaacgtgtacggcgtacgcacaacgtctctcttactactcctcctacc

SEQ ID NO: 365131 - DNA, 538 bp, Homo sapiens
  misc_feature: GZ8MTXP02HB8DU.13.53.E09.1.454.CMB.2.raw
  modified_base (286)..(286): a, c, t, g, unknown or other
  modified_base (349)..(349): a, c, t, g, unknown or other
  modified_base (528)..(528): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaagccccgaactccngactcgtacggtacatccactttgcacaggtggatcccatcccgaaggttcagtggcagtagntctaggaaactagtactttaccctcaacctatcgacggggtctaacgagacctagtaagtattttgacgtacttactattgtacaactagtacgttacccttccgccccggtacgttcggacgagggaccaaggtagaaactacgaagcgaaactggcgctcgcacaatctcgtctacnctcttaccgc

SEQ ID NO: 365132 - DNA, 618 bp, Homo sapiens
  misc_feature: GZ8MTXP02JEXVW.13.53.E09.1.454.CMB.2.raw
  modified_base (196)..(196): a, c, t, g, unknown or other
  modified_base (284)..(284): a, c, t, g, unknown or other
  modified_base (335)..(335): a, c, t, g, unknown or other
  modified_base (340)..(340): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctcatccaccctgtctgcgtctctcgganacagggtcaccatcacttgcggcaagtcagaacattggctaactctttaaagtgtatcagcagaagtcaggcaacgccccgaactccngatctacgtacatccactttgcacagtggactccatccagttcagtcgganagtantacgagaactacgttacctttaccacgactagtacgtacggtactacgacgtacgtagtaacgttacgtttacgtactaacttacttagttacgtaactaacgttacgttaccgtttacccgttaccccgtaccccggtaccgttaccggaaccggtaaacgggaaccgtaaagggtaacgaaaacgtaaccgtaaacggaccggtaacgtaggtacggtacgtaccgacctaacctaacgttcggtacgttactacctacttacccggttacctacg

SEQ ID NO: 365133 - DNA, 584 bp, Homo sapiens
  misc_feature: GZ8MTXP02HPB0E.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaactctttaaatggtatcagcagaagtcagggcaacgccccgaacctcctgactctacggtacactccactttgcactaggtcggactcccatcccaaggttcagtggacagtagatcgtaggaaactagtaacttttaccccacaaccctatccgtaggggtactacgagcccttagaagtactttgcgtacttacttattgtacaaactgtacgttaccctaccgtcccccggtagttccggtaccgaacgggaacccgtaagggtaacgaaaacgtacgtaaaggcgtaaacgtggtcgctcgaccacaattcgtacgttctactacttccgttacccgtc

SEQ ID NO: 365134 - DNA, 801 bp, Homo sapiens
  misc_feature: GZ8MTXP02GPZPE.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaactcttaaattggtatcagcagaagtcgaggcaacgccccaacctcctgactctacggtacatcccactttgacacgtaggtacgggtactccccccaagtaccgtaaaagggtttccaaggggtttacgggacctagggttaacgtaacgtttaccggttaacgggtaaaacccgtaacgggtttaaaccttttttaaacccccgacgtaaaccctaacgttaccgggaacgggggtttaccctaaaccgtacggtaccccgttaagggtaaacgtttacgtttttacggacccggtttaaaacttttaacccgtttaaagtttaccggttaaccgtaaaacccgtaacgggtttaaccgtttaacccccgttttaccccggttacccccccgggggttaaccggttttaccccggggacccggtaaaccggggtaaacccgaaaacggggttaacgtaaaacggtactaaacgggacgtaaaaccgttggtaaccggtcgttacggaacctaaccgtaacgttccgttacgttcctttaccgtactttcccccg

SEQ ID NO: 365135 - DNA, 543 bp, Homo sapiens
  misc_feature: GZ8MTXP02J12LS.13.53.E09.1.454.CMB.2.raw
  modified_base (345)..(345): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatcccatccaaggttcagtggcagtagntctaggaacagtacttttaccctcaaccactcgacgggtctacacgcctgacgatttgcgtacttactattgtcaacagtacgttaccttacctccccgtacgttcggaccgtacgggaccgaacgtacgggggaaatacgaacgacgaacgtagttacggctcgcgaccaatcgtcgtcttcactacctccgtaccc

SEQ ID NO: 365136 - DNA, 570 bp, Homo sapiens
  misc_feature: GZ8MTXP02GLXOU.13.53.E09.1.454.CMB.2.raw
  modified_base (343)..(343): a, c, t, g, unknown or other
  modified_base (367)..(367): a, c, t, g, unknown or other
  modified_base (387)..(387): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaattggtatcagcagaagtcagggcaagccccgaacctcctgatctacggtacatccactttgcacagtggatcccatccaaggttcaagtgcagtanatctaggaacagtacttttacccncaccatcgaggggtctaacngacccttagaagtattttagcgtacttacttaattcgtacaaacgtagtacgtttaacccttccgtacccccggtacgtccggtaccgaaacgggaacccgaaagggtaggaaaacgtacgaaacgacgtaacgtagtagggctcgacaccaagttctacgttcttctacttccttaccctcc

SEQ ID NO: 365137 - DNA, 671 bp, Homo sapiens
  misc_feature: GZ8MTXP02JYYAI.13.53.E09.1.454.CMB.2.raw
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaactctttaaatggtatcagcagaagtcgaggacaagcccccgaactctagatctacgtacactccactttgcacgaggtcggatcccccatacaaggttcaggtcggacaggtagactacgtaggaaactagttaacctttttaccccactaacccgtaatcccgtagggggttacctacgacgtaccgtaggtaaacgttagttttacgaccgttaactttaacttaagtttcgtaactaaactacgggttaaccgttttacccttacccggttacccccgggaacgtttccgggaacccgttaaacggggaaacccgtaaacgggttaacgggaaaacttacgaaaacggtacggtaaaaccgtggttaccggacgtcggaaccgtaccctaagttccttcggtacctttcgaaccgtttccccg

SEQ ID NO: 365138 - DNA, 633 bp, Homo sapiens
  misc_feature: GZ8MTXP02GD01Z.13.53.E09.1.454.CMB.2.raw
  modified_base (344)..(344): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcaagaacattggacaactctttaaatggtatcagcagaagtcaggcaagccccgaacctcctgactctacggtacactccactttgcacagtggatccatcaagttcagtgcagtantcgtggaaactagtactttttaacccnctaaccagtcgaacggggttacctaacgacgtcccgtagaaagtacttttagggactaactttacttaagttcgtaactaaacgtagtacgtttaacccgttaccgtaccccccgggtacgtttaccggacccggaaacgggtaaccgaaacgggttacggaaaacgttacgaaacgaccggtaaacgtacggttaacggcgtacgccgtacctaactaccgttcgttacttaccgtaacttcccttacccggttaaccccg

SEQ ID NO: 365139 - DNA, 531 bp, Homo sapiens
  misc_feature: GZ8MTXP02IO5UT.13.53.E09.1.454.CMB.2.raw
  modified_base (414)..(414): a, c, t, g, unknown or other
  modified_base (486)..(486): a, c, t, g, unknown or other
  modified_base (514)..(514): a, c, t, g, unknown or other
tcagtcacgtactacacgaccggtgctcgatttagagagagtgtgttgggtttgggggcaggagtcagtctcagtcaggacacaacatggacatgagggtccccgctcagctcctggggctcctgctactctggctccgaggtgccagatgtgacatccagatgagccagtctccatcccaccctgtcctgcgtctctcggagacagggtcaccatcacttgtcgggcaagtcagaacattggcaactctttaaattggtatcagcagaagtcaggcaacgccccgaacctcctgatctacggtacatccactttgcacagtggactccatcaagtcagtgcagtagatctaggacagtactttacccacaccatcgagggtcacagcctagaagtatttcgcgtacttaactnttagtacaatacgtactttaaccctcccgtaccccggtacgttcggacgacggaaccgaaggtaagaactanaagacgatcgtacgctgacaacactctntactctactacttcccg

SEQ ID NO: 365140 - DNA, 548 bp, Homo sapiens
  misc_feature: GZ8MTXP02IXR1F.13.53.E09.1.454.CMB.2.raw
  modified_base (236)..(236): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacnttggcaactcttaaatggtatcagcagaagtcagggcaacgccccgaaactcctagactctacggtacatcccatttgcacagtggactcccccatcaaggttcagtcggcagtagatcgtaggaactagtacttttacccacacctatcgaggggtctacgacgcctagaagtatttagacgtaacttactattacgtactaactaggtacttaaccttccgtaccccggtacgttccggaccgtaacggaccgaaggtacgaagtaccgaagacgaacgtgtacgcagcgactatctcgtctcacttccc

SEQ ID NO: 365141 - DNA, 689 bp, Homo sapiens
  misc_feature: GZ8MTXP02HG1UT.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaacttctttaaatggtatcagcagagtcagggcaacgccccgaactcctgactctacgtacactccactttgcacgagtcggactcccatacccgtaaggttccaggtggactaaggttagatcgtaggaaactagttaaccttttaccccactaaccctacgtccggtaacgggggttcctaacgtacgtacccgttaggtaaacgttagtttttacggaccgtttaactttacttaacgtttacgttaaccaacgttacgttaaccgtttacccgtttaccccgtacccccggtacggtttacccggaacccggtaaacggggaaccgtaaaacggggtaacgtaaaacgttaaccggaaaacggaccggtaaacgtacgggtcgggtacctacggtacctaccgtaactccgttacgttacttcctaccttacccgtttccctaaccg

SEQ ID NO: 365142 - DNA, 549 bp, Homo sapiens
  misc_feature: GZ8MTXP02F9AU6.13.53.E09.1.454.CMB.2.raw
  modified_base (341)..(341): a, c, t, g, unknown or other
  modified_base (366)..(366): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggcaactcttaaatggtatcagcagaagtcaggcaacgccccgaacctctgatctacggtacatccactttgcacgagtggatcccatccaagttcagtgcagtagntctaggaaactagtacttttacccncaccatcgagggtctacagcctagaagtatttgacgtacttactaattcgtactaaactagtacgtttacccgttccgtaccccccggtagttccggaccgaacgggacccgaaggtacggaaactacgaagacgaactgtacggactcgcactaagtctagtcttactactccttccgtacc

SEQ ID NO: 365143 - DNA, 573 bp, Homo sapiens
  misc_feature: GZ8MTXP02JJZ38.13.53.E09.1.454.CMB.2.raw
  modified_base (284)..(284): a, c, t, g, unknown or other
  modified_base (344)..(344): a, c, t, g, unknown or other
  modified_base (404)..(404): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattgtatcagcagagtcaggcaagccccgaactccngatctacgtacatccactttgcacagtggactcccgatccaaggttcagtggacagtagntcgtaggaaacagtacttttacccacacatcgaggggtctaacgacgtcctagtaacgtntttagacgtacttacttattagtacaactgtaacgtttccctaccgtcccccggtagttcgaccgaaggaccgaaggtagaaactacgaagtacgaacgtaggtcggtcgtacggtaccaaccgtaacttcgtacgtttccttactaccggttcccttccccggtaacc

SEQ ID NO: 365144 - DNA, 601 bp, Homo sapiens
  misc_feature: GZ8MTXP02HYFOO.13.53.E09.1.454.CMB.2.raw
  modified_base (286)..(286): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaacttctttaaatggtatcagcagagtcaggcaagccccaactcngatctacgtacatccatttgcacagtggactcccccatcgaaggttcaggtgacagtagatcgtagaactgtaacttttacccactaccatcgagggtactacgtagcctagtaacgtatttcgacgttaacttacttattcgtacaaacgtacgtaacgtttaccctaccgtacccccggtacgtttaccggaccgtaaacgggaccgtaacggtacggtaaaacgtacgaaacgtacggtaaacgtacgttcggaccgttacgaaccgtaaccgtacttaccggttacgttacctttacgttaaccttccccg

SEQ ID NO: 365145 - DNA, 545 bp, Homo sapiens
  misc_feature: GZ8MTXP02IP7JL.13.53.E09.1.454.CMB.2.raw
  modified_base (343)..(343): a, c, t, g, unknown or other
  modified_base (370)..(370): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccaacctcctgatctacggtacatcccatttcgcacagtggatccccatcaagttcagtggcngtagatctagaacagtacttttacccncaccatcaggggtctacagccctgaagtatttagcgtacttactattgtactaactagttacgttaacccttccgtcccccggtacgttaccggaccgtaacgggaccgaaggtacggaaacgtacgaaacgacgaaacgtgtcgctcgcaccactctacgtcttcactttcccg

SEQ ID NO: 365146 - DNA, 564 bp, Homo sapiens
  misc_feature: GZ8MTXP02FZBZY.13.53.E09.1.454.CMB.2.raw
  modified_base (364)..(364): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacgtacatccactttgcacagtggatcccatcaaggttcagtgcagtagatcaggaacagtacttttacccncacctatcgagggtctacagcctagaagtattttgacgtacttactattgactaacagtacgttaaccttcctacccccggtacgtttccggaccgaaacggggaccaaacgggtacggaaaacgtacgtaaacggacggaactaggtcggacgttacgctacccaattctagtccttactactcccgtttcccgtaccc

SEQ ID NO: 365147 - DNA, 569 bp, Homo sapiens
  misc_feature: GZ8MTXP02JZYVS.13.53.E09.1.454.CMB.2.raw
  modified_base (403)..(403): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaacttcttaaattggtatcagcagaagtcagggcaacgccccgaacctcctgatctacggtacactccctactttgcacagtggactcccccatcaaggttcagtgcagtagatctgaacagtactttacccacaccatcgagggtctacagcctagaatntttgcgtactttatattgtacctaatagtaccgtttaccttccgtcccccggtacgttccggaccgtaacgggaccgaaaggtacggaaaacgtacgaacggtacgtaaacgtcgtacggtcgtcgccgtacccgtacttcgttcgttcctttctaactttccccg

SEQ ID NO: 365148 - DNA, 563 bp, Homo sapiens
  misc_feature: GZ8MTXP02JEW8L.13.53.E09.1.454.CMB.2.raw
  modified_base (344)..(344): a, c, t, g, unknown or other
  modified_base (365)..(365): a, c, t, g, unknown or other
  modified_base (392)..(392): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacgtacatcctactttgcacagtggactccataccaagttcagtgcagtagntcaggaacagtactttacccncaccatcgagggtctacagctagagtntttgactacttactattgacaacgtgtacgtttacccttccctacccccgggtacgttccggaccgaaacgggtaccgaagggtacgaaaacgtacaacggtacgaaacgtggtacggtctacgcctaaccgtaagtcttcgttaccttcgtactttccgttaccccgtac

SEQ ID NO: 365149 - DNA, 567 bp, Homo sapiens
  misc_feature: GZ8MTXP02I269S.13.53.E09.1.454.CMB.2.raw
  modified_base (346)..(346): a, c, t, g, unknown or other
  modified_base (350)..(350): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagaagtcagggcaagccccgaactcctgatctacggtacatccactttgcacgagtggactccccatcaagttcagtggcngtanatctaggaactagtactttaccctacacctatcgaggggtactacgacgccctagaacgtatttagcgtaacttacgttattagtactaactagtacgttacccttccgtaccccggtacgttcgaccgtaacggaccgtaaggtacgaaacgtacaaacgacgtaacgtagtacggctacggaacgacctactacgtcgtacttactactttcccg

SEQ ID NO: 365150 - DNA, 555 bp, Homo sapiens
  misc_feature: GZ8MTXP02FM9RC.13.53.E09.1.454.CMB.2.raw
  modified_base (343)..(343): a, c, t, g, unknown or other
  modified_base (364)..(364): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcatttgtcgggcaagtcagaacattggcaactcttaaattggtatcagcagaagtcagggcaagccccgaactcctgatctacggtacatccactttgcacagtggatcccatccaaggttcagtgcagtagntctggaacagtactttacccncaccatcgaggggtctacagcctagaagtattttgcgtacttactaattcgtacaaactagtacgtttaacccttccgtacccccggtacgttccggaccgaacgggaaccgaaacggtacggaaaagtacgaaacgacgtaaacgtggtacggtcgtacgacacaatctacgtcttactactctccctcc

SEQ ID NO: 365151 - DNA, 725 bp, Homo sapiens
  misc_feature: GZ8MTXP02HO3LI.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgacgccagtcctccatccaccctgtctgcgtctcgtcggagacagggtcaccatcacttggtcggcaagtcaagaactgttggactaacttactttaaagttggtatcgagcaagaagtcgaggccaacgcccccgaactccgtagactcgtaaccggtactactccctactttcgctaacgtaggtcgggactccccaagtaccccgtaaagggtttaccaggtcggtacgaaggttacgtagttacgtagggtaaactaacggttaacctttttacccgactaacccgtacttacggacggggtttacaacgtacgtacccgttaggaacgtttacgttttacgacgttaactttaacttacgtttacggtaacctaaacgttaacgtttaacgtttaccccttcccggttacccccggtacggttaccgggaccgtaaacggggtaaccgtaagggtaacgtaaaacgtaccgaaaggtaccgtaactacgggttacgcgttaccggactaccgtaacgttctaaccggtttctacgtttactcccggttttacccctaaccg

SEQ ID NO: 365152 - DNA, 589 bp, Homo sapiens
  misc_feature: GZ8MTXP02IQRSC.13.53.E09.1.454.CMB.2.raw
  modified_base (358)..(358): a, c, t, g, unknown or other
  modified_base (383)..(383): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcgggcaagtcagaacattggactaacttctttaaattggtatcagcagaagtcgaggacaacgcccccgaacctcctagactacgtacgtacatcctactttgcacagtggactaccataccgagttcagtgacagtagntcgtaggaaactagtacctttaccnctacagtcgtacgggtactacacgtaccgtagtaaagtgttttacgaccgttacttagttatttacgtacaaacgtagtaccgtttacccttacccgtccccgtacggtcgtaccgaaacggacgaagggtacgaaactacgaacgacgtaacgtacggtcggctcgtaccactaacgtctcgtcttactcttaccttcccgtacc

SEQ ID NO: 365153 - DNA, 669 bp, Homo sapiens
  misc_feature: GZ8MTXP02HZL2F.13.53.E09.1.454.CMB.2.raw
  modified_base (608)..(608): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccgtcaccctcgtctgcgtctctcggagacaggtcgaccactctacttacgttcgggcgaagtactacgaaacaattggtacgaaaccttactttaaatttaggttatctagacagaaagtacgaggacgaacgaccccgacccgtacctcgatctacggtaaccgatcctactttacgtcactacggtgggtacgtacccctatactaaccggtagtacgtgggcagtagtatccgttaggaaacacgttacttttacccgtcaaccaactcgtaaggggccttaacacgccgtagtaaagtagtttttgacgacctttattattcggttacaaactaaggttacctttaccctttcccgtaccccccggtacggtttacggcccgtaaaggggaacctaaacgggtgtaaaacgtaaccaaggacgttaaacccgngttggggtactcgacgtaaccactcgttcgtactttcaccttaccgtttcccgaccctacg

SEQ ID NO: 365154 - DNA, 740 bp, Homo sapiens
  misc_feature: GZ8MTXP02I6S9W.13.53.E09.1.454.CMB.2.raw
  modified_base (226)..(226): a, c, t, g, unknown or other
  modified_base (304)..(304): a, c, t, g, unknown or other
  modified_base (324)..(324): a, c, t, g, unknown or other
  modified_base (381)..(381): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtccaccatcacttggcggganaagtcaagaactagttggactaacttactttaaagttggtaatcagcaagaagtcgagggacaacgccccgaacctcngactcgtacgtacactcctntttagcacgaggtaggacctaccgtatacccgtaaggttcgagtcggactagttagntacgtaggaaactagttacctttacccgacaacctacgtcgaagggttcctaacgtacgtacccgttagaagttacgttttacgaccgttaactttacgttagttacgtaacgtaaacgtacgttaaccgtttaaccccgttcccgtaacccccgggttacgggttacccgggaacccggtaaaaccggggtaaccggtaaaacggggtacggtaaaaacgttaccggaaaaaccggtaccggtaaacccggttaaggttcgggtacccgttacggaaccccgtaaacctaaccgtttaccgtttacggttaccctttaaccgtacccttttacccccggttacccccggttaaccccg

SEQ ID NO: 365155 - DNA, 574 bp, Homo sapiens
  misc_feature: GZ8MTXP02G5XX6.13.53.E09.1.454.CMB.2.raw
  modified_base (344)..(344): a, c, t, g, unknown or other
tcagtcacgtactacacgaccggtgctcgatttagagagagtgtgttgggtttggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtggatcccccatcaaggttcagtgcngtagatctagaacagtactttaccctcaccatcgacggggtctacagcctagaagtatttcgacgtactttactattgtacaaacgtagtacgtttacccttccgttacccccggtacgtttccggaccgtaaacggggaacccgtaaagggtacggaaaacgttacgaaacgacgtaaaccgtaggtcggcgtacgaacgacccattcctacgttcttacactttcccg

SEQ ID NO: 365156 - DNA, 547 bp, Homo sapiens
  misc_feature: GZ8MTXP02FTC83.13.53.E09.1.454.CMB.2.raw
  modified_base (197)..(197): a, c, t, g, unknown or other
  modified_base (285)..(285): a, c, t, g, unknown or other
  modified_base (342)..(342): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcggcaagtcagaacattggcaactcttaaatggtatcagcagaagtcagggcaacgccccgaactccngatctacggtacatccactttgcacagtggatccatccaaggttcagtggcagtagntctggaactagtactttacctcaccatcgagggtctacagcctagaagtatttcgacgtacttactattcgtacaacagtacgtttacccttaccgtccccccggtacgttacggaccgtaaagggaccgaaacggtaggaaaactacgaagacgtaacgtacgtgcgtacgcaccaatacgtctacttcactccttcccgtacc

SEQ ID NO: 365157 - DNA, 548 bp, Homo sapiens
  misc_feature: GZ8MTXP02I2V1U.13.53.E09.1.454.CMB.2.raw
  modified_base (399)..(399): a, c, t, g, unknown or other
  modified_base (415)..(415): a, c, t, g, unknown or other
  modified_base (467)..(467): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtccaccatcacttgtcgggcaagtcagaactattggactaacttcttaaatggtatcagcaagaagtcgaggcaacgccccgaactctagactctacggtacactcctactttgcacgagtggactcccccatcgaaggttcagtgcagtgatcgagaactagtactttacccacactatcgagggtacanacgtcctagtaagttnttagacgtacttacttattgtacaacgtagtaccgttaccctcgtaccccgngttcgaccgtaaggacgagtacgaatacgaacgacgaacgtcgacgcgtacgcgtacacttcgtattctactactttcccg

SEQ ID NO: 365158 - DNA, 626 bp, Homo sapiens
  misc_feature: GZ8MTXP02IRAXZ.13.53.E09.1.454.CMB.2.raw
  modified_base (232)..(232): a, c, t, g, unknown or other
  modified_base (435)..(435): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacnttggacaacttactttaaattggtatcagcagaagtcgaggcaacgcccccgaactcctagactacctacggtacataccctatttcgactaacgaggtacgggactccccgatacccgtaaggttcaggtggacagttagatcgtaggaactagttactttacccacaccatacgagggtctaacgacgtcctagtaagttnttttacggacttactttaacgtatttacgtaacaaacgtagttaacgtttacccgttcccgtaccccggttacgttaccggaacgaaacgggtaaccgaagggtacggtaaaacttacgaaaacggacgtaacgtagtcggtacgtacgacacgtaactccgttacttacctactaccgttccgttaccac

SEQ ID NO: 365159 - DNA, 667 bp, Homo sapiens
  misc_feature: GZ8MTXP02H23EW.13.53.E09.1.454.CMB.2.raw
  modified_base (239)..(239): a, c, t, g, unknown or other
  modified_base (375)..(375): a, c, t, g, unknown or other
  modified_base (443)..(443): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacagggtccaccatctacttggtcgggacaagtcagaacnttggactaacttctttaaattggtatcagcagaagtcgagggacaacgcccccgaacctcctgactcctacggtacatcctactttgcacgaggtacggactccctataccgaaggttcaggtcggacaggttagntcgtaggaactagttacttttacccactaaccctatacgtacgggtcctaacgacgtcctagtaagtnttttacgacgttacttacttattacgtactaaactagttaccgtttacccgttacccgtacccccgggtacgtttacccgggacccgtaaacgggggaaccctaaaggggtacggaaaacgttacgaaacggtaccggtaaacgttacgggtacggtaccgtacggaaccctaccgtaagttccgttacggttcctttacctacctttcccgtttaccccgccc

SEQ ID NO: 365160 - DNA, 594 bp, Homo sapiens
  misc_feature: GZ8MTXP02H0LNU.13.53.E09.1.454.CMB.2.raw
  modified_base (201)..(201): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttggtcgggcaagtcagaacattggcaactcttaaatggtatcagcagagtcaggcaagccccgaactcctagactctacgtacatcactttgcacagtggatccccatcagtcagtggcagtagatcgtagaactagtactttaccctcactatcgagggtacacgacgcctagaacgtatttgacgtactttacctattagtacaaactagtacgtttaccttccgtacccccggtacgttacggacccgtaacgggaaccgaaacggttaacggaaaacgttacgaaacgtaccggtaaacgtacggttacggaccggttcgaaccgtacccgtaaacttccgtgtttacccgttacttaaccggtttcccccg

SEQ ID NO: 365161 - DNA, 550 bp, Homo sapiens
  misc_feature: GZ8MTXP02GYPH8.13.53.E09.1.454.CMB.2.raw
  modified_base (373)..(373): a, c, t, g, unknown or other
  modified_base (519)..(519): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctcatccaccctgtctgcgtctctcggagacaggtcaccatcacttgtcgggcaagtcagacattggcaactcttaaattgtatcagcagaagtcagggcaagcccccgaactcctgactctacggtacatcctactttcgacacgtagtcggactcccatcccgaaggttcagtggacagtagctcaggaactagtactttaccncacatcgagggtctacgagtcctagacgtatttcgacgtacttactattcgtacaacgtagtacgtttacccttaccgtcccccggtagttccggacgtacggaacaggtacgaaatcgaagacgaactggtcgactcgctaacgngttcctacgttctactactcccgtaccgtcc

SEQ ID NO: 365162 - DNA, 547 bp, Homo sapiens
  misc_feature: GZ8MTXP02I8PW6.13.53.E09.1.454.CMB.2.raw
  modified_base (289)..(289): a, c, t, g, unknown or other
  modified_base (346)..(346): a, c, t, g, unknown or other
  modified_base (370)..(370): a, c, t, g, unknown or other
  modified_base (397)..(397): a, c, t, g, unknown or other
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggacaacgccccgaactccngactctacggtacatccactttgcacagtggactcccatcgaagttcagtgcagtantcgtaggaactagtactttacccncacatcgagggtctagagctagaagtntttagactacttactattgtacaactagtacgttaccttaccgtaccccggtagttccggacgtaaacggacgtaagggtagtaaaactcgaacgtacgaacgtgtacggtctacgcactaacgtctacgttcttacacttcctcctacc

SEQ ID NO: 365163 - DNA, 728 bp, Homo sapiens
  misc_feature: GZ8MTXP02FNF67.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgcagatgtgacatccagatgagccagtcctccatcccaccctgtctgcgtctcgtcggagacgagggtccaccatcacttggtcgggacaagtcaagaactagttcggacaacttactttaaattggtaattcagcagaagtcgagggcaacgaccccgaacctcctgactctacggtacactcctaactttcgacactaggtacgggactccccgatacccgaacgggtttccaaaggttcggactaaggttagtagtaccgtagggaaactaacgtaacctttttaaccccctaccaaacccgtacttacggaacgggggtttacctaaccgtacggtcccttaaggaaacggtttaagtttttcggaccgttaaacctttaacttaaagtttcgtaactaaaccgtaagtaaccggttttaccccgttacccgttacccccccgggttacggttacccggtacccggtaaacggggaaccggtaaacgggtacggtaaaacgtacgaaacgtaacgtaaacgtggtacggtacgtcggactaccgaacgtactcgttaccttcctaacttcccgttcccttacccg

SEQ ID NO: 365164 - DNA, 659 bp, Homo sapiens
  misc_feature: GZ8MTXP02IG1DE.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcagaacattggcaactcttaaatggtatcagcagaagtcaggacaacgccccgaactcctagactacgtacgtacactccctactttgacacgaggtaggactacccccatacgtaaggttcaaggttcgactagtagatcgtaggaactagtacttttacccacaccagtacgacgggtctaacgagtacctagaacgttatttacgacgtaactttacttattacgtactaaacgtagttaaccgtttaccccgttaccgtacccccgggtacgtttaccgggaccgtaaacggggtacccgtaaaagggttacggaaaacgttaccggaaaacgtaccggaaaacgtttcggtaacgggtacttacgggaaccctaaccgtaacggttcccttaacggtttccctttacgttaacgtttcccccg

SEQ ID NO: 365165 - DNA, 565 bp, Homo sapiens
  misc_feature: GZ8MTXP02F7P9S.13.53.E09.1.454.CMB.2.raw
  modified_base (351)..(351): a, c, t, g, unknown or other
  modified_base (373)..(373): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcagacattgcaactctttaatggtatcagcagaagtcaggcaacgaccccgacctctgactctacgtacactcctactttgcacgaggtggactcccatacccaaggttcaggtggcaggtagntcaggaacagtacttttacccncacctatcgagggtcacagcctagaagtatttcgacgtacttatattgacaacgtagtactttaccttcccgtaccccggacgttccggaccgaaacgggaccgtaacggtagaaacgtacaaacggacgaacgtcggtacggccgttacgccactaacgtcttcgttccttcacttccgttaccctacccg

SEQ ID NO: 365166 - DNA, 799 bp, Homo sapiens
  misc_feature: GZ8MTXP02HMXAH.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtccaccatcacttggtcgggacaagtcaagaactagttggactaacttacttaaagttggtatcgagacaagtaacgcgaggacaacgacccccgaactcctagtactaccgtaccggtaactactaccctacgtttcgaccaacgtacggtacgggtacctccccgtaagttacccgtaaacggtttaccgaggttacggaccgtaaggttagacgttacgtaacgggtaaacttaccgtttaacctttttaacccccactaaacccgtaacgttaccggaacggggttacctaaacgacgtcccgttaaggtaacgtttagttttacggaccttaaacctttaacgtttaagtttcggtaaactaaaccgttacgttaacccgttttaaccccgttccccggtaccccccgggttaacggtttacccgggaacccggtaaaacggggtaacccggtaaagggtaacgggtaaaaccgttaacggaaaacggtaccgtaaacggttcggttacggaccgttaccggacctaaaccgtaactttccggttaactttccgttaaccttacccttacccggttttccccgtaacccg

SEQ ID NO: 365167 - DNA, 552 bp, Homo sapiens
  misc_feature: GZ8MTXP02I9S17.13.53.E09.1.454.CMB.2.raw
  modified_base (197)..(197): a, c, t, g, unknown or other
  modified_base (284)..(284): a, c, t, g, unknown or other
  modified_base (340)..(340): a, c, t, g, unknown or other
  modified_base (365)..(365): a, c, t, g, unknown or other
  modified_base (538)..(538): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcggcaagtcagaacattggcaactctttaaatggtatcagcagaagtcaggcaagccccgaactccngatctacggtacatccactttgcacagtggatcccatcaagttcagtggcagtacntctaggaaactagtacttttacccncaaccatcgaaggggtctacgagcctagagtatttgactacttattatcgtacaaacagttacttacccttaccgaccccggtacgttacggaccgaaaggacccggtaaacggtagaaaacgtacgaaacgacgaaaccgtgtcggacgtacgacctacaatcgtcttctanaccttcctacctcc

SEQ ID NO: 365168 - DNA, 673 bp, Homo sapiens
  misc_feature: GZ8MTXP02HFXNA.13.53.E09.1.454.CMB.2.raw
tcagtcacgtactacacgaccggtgctcgatttagagagagtgtgttgggtttgggggagtcagtctcagtcaggacacagcatggacatgacgggtccccgctcagctccgtggggctcctgctactctggctccgaggtgccagatgtgacatccagatgagccagtctccatcccaccctgtctgccgtctcgtcggagacgagggtccaccatcctacgttggtcgggacaagtcaagaactatggactaacttactttaaatggtatcagcagaagcaggacaacgccccgaacctcctgactacgtacgtacacttcctactttgacacgacggtggactaccccgtataccccgtaaaggtttccaggtcggacgtaagtagtacgtacgtaaggaaaacgtacgttaacctttttaccccactaaccctaacgttacggtacggggttacctacgacgtaccgtagtaagtagtttcgacgtactttactattcgaactacgtagtaccgtttaccgttacccgtaccccggtacgttccggtaaccggaacggtaaaccggtaacggtaaaggtaaacgtaacgaaacggacgtaaaccgtggtcggaacgtcgacctaacaacgttcgttaccgtcttaaccgtacttaccgtacccgttccc

SEQ ID NO: 365169 - DNA, 623 bp, Homo sapiens
  misc_feature: GZ8MTXP02G638C.13.53.E09.1.454.CMB.2.raw
  modified_base (348)..(348): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaacttcttaaattggtatcagcagaagtcaggcaacgccccgaacctcctgatctacggtacatccactttgcacagtgggactcccatccgaagttcagtggcagtagntctaggaacagtacttttacccncaaccctatacgaggggttactacgacgtccctagtaagtatttttcgacgtacctttaacttagtttacgtaacaaacgtagtaacgtttacccgtttacccgtacccccgggtacgtttcggacccgaacggacccgaaagggtagaaacttacgaacggtacgaaacgttacggacggtccgttacggacctaaccgtaacttaccggttacgttctttacctaacgtttcccttcccggtttaacccg

SEQ ID NO: 365170 - DNA, 556 bp, Homo sapiens
  misc_feature: GZ8MTXP02GGTF6.13.53.E09.1.454.CMB.2.raw
  modified_base (344)..(344): a, c, t, g, unknown or other
  modified_base (365)..(365): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaattggtatcagcagaagtcagggcaagccccgaacctcctgatctacggtacatccactttgcacagtgggatcccatccaaggttcagtggcagtantctggaacagacttttacccncaccatcgaggggtctacagccctagaagtattttgacgtacttactattgtacaactagacgtttaccttcctcccccggtacgttcggaccgtaacgggacccgtaaagggtacggaaaacgtacgaaacgacgaaccgtaggtacggcgtcggcaccgaacgtactcgtcttcacttcttcccgtacc

SEQ ID NO: 365171 - DNA, 727 bp, Homo sapiens
  misc_feature: GZ8MTXP02HJQKS.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtcaccatcacttggtcgggacaagtcaagaacattggactaacttacttaaattggtatcagcaagaagtcgagggacaacgcccccgaacctcctagactacgtaccggtacacttcctaactttcgacaacgtaggtcgggaacctcccctaataccccgtaaaggtttccaggtggactaggttagacttcgtaggaaactacgttaaccttttaccccgactaacctacgtaccgtagggggttacctaacgtacgtacccgttaggtaaacgttagttttacggacgttaacgtttaacttagtttacgtaaccgtaaaccgtaggttaaaccgtttaccccgtttaccccgtacccccgggttacggttacccggtaaccggtaaaccggggaaaccgtaaacgggtaacggtaaaacgtaacgaaacggtaacggtaaacgtacggtacggtacgtaccgtaccgaacctaacgttcgtaacggttccttactttacctcccgtttcccgaacccg

SEQ ID NO: 365172 - DNA, 575 bp, Homo sapiens
  misc_feature: GZ8MTXP02IFUZ2.13.53.E09.1.454.CMB.2.raw
  modified_base (287)..(287): a, c, t, g, unknown or other
  modified_base (352)..(352): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggacaagtcagaacattggctaactctttaaatggtatcagcagaagtcaggcaacgccccgaactccngatctacggtacactccactttgcacgaggtgggactcccatccgaaaggttcagtggcagtagntcgtaggaactagtactttaccacaccatcgagggtctacagcctagaagtattttcgacgtactttactattgtacaaaactgtaacgtttacccttaccgtacccccggtacgttccggtaccgaacgggaaccgtaacgggtacggaaaacgtactaaacggaccgaaacgtggtacgccgtacgaccaccaatctcgttctactactccttcccgaccc

SEQ ID NO: 365173 - DNA, 587 bp, Homo sapiens
  misc_feature: GZ8MTXP02HGE0P.13.53.E09.1.454.CMB.2.raw
  modified_base (345)..(345): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagacattggcaatctttaaattggtatcagcagaagtcagggcaagcccccgaactcctgatctacggtacactcctactttgacacagtgggactccatccaagtcagtgcagtantctaggaacagtactttacccacacctatcgtagggtctacgacgtcctagtaacgtatttgacgtacttactattcgtacaacgtagtacgtttacccttccgtacccccgggtacgttccggtaccgaaacgggaccgtaacgggtagaaaacttacgaaacggtacgaaaccgtaggtacggtaccgtacgtccaacctaagttctacgttccttacctacttccctttacccggtccc

SEQ ID NO: 365174 - DNA, 559 bp, Homo sapiens
  misc_feature: GZ8MTXP02G81H6.13.53.E09.1.454.CMB.2.raw
  modified_base (319)..(319): a, c, t, g, unknown or other
  modified_base (374)..(374): a, c, t, g, unknown or other
  modified_base (543)..(543): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtccaccatcacttggtcgggacaagtcagaacattggcaacttcttaaatggtatcagcagaagtcaggcaagccccgaactctgatctacggtacactccactttgcacgngtggactccccatcaagttcagtgcagtagatctaggaactagtacttttacccncacatcgacggggtactaacgagtcctagaaacgtattttacgacgttaactttaacttattacggtactaacgtagtacgtttacccttcccgtaccccggtacgttccggtacgaacgggaacgaacggtaacggaactacgaacgtacgaactcgacgctagcacnctactgtctctactcc

SEQ ID NO: 365175 - DNA, 649 bp, Homo sapiens
  misc_feature: GZ8MTXP02IG6L7.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacgttggtcgggacaaggtcagaactattggactaacttcttaaattggtaatcagcaagagtcgaggacaacgccccgaacctccgtgactcgtaacggtacactcctactttcgacaacgaggtcggactacccccatacgtaaggttcaggtggactagtagatacgtagaaactacgttaaccttttacccactaacctacgtacgacggggttacctaacgtacgtaccgtaagtaaacgttatttacggacttaactttacttattacgttacaaacgtacgtaccgtttaacccgttcccgtaccccgggtacgtccggtaccggaacgggtaacgtaaacgggtacgtaaaacgtacgtaaacgaacgtacgtacggtacgtacgtacgccgtacgacttcgtcgtttccttacttaccgttcccg

SEQ ID NO: 365176 - DNA, 624 bp, Homo sapiens
  misc_feature: GZ8MTXP02JC0S0.13.53.E09.1.454.CMB.2.raw
  modified_base (287)..(287): a, c, t, g, unknown or other
  modified_base (345)..(345): a, c, t, g, unknown or other
  modified_base (367)..(367): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcatttgcgggcaagtcagaacattggcaactcttaaattggtatcagcagaagtcagggcaacgccccgaacctccngatctacggtacatcctactttgcacagtggatcccatccaagttcagtggcagttantctggaacagtacttttacccncaccatcgaagggtctaacagcctagtaacgtattttaggcgtactttactaagttcgtactaaactagtaacgtttacccttacccgtacccccggtacggtttacggacccgaaacggggaacccgtaaacgggttaacgggaaaacttacggaaaacggtaccggaaaccgtacggttagggccgttacggaccaaacccgtaacttaccggttacgttacccttaccttaccgttcccgtttaccccgtaccg

SEQ ID NO: 365177 - DNA, 556 bp, Homo sapiens
  misc_feature: GZ8MTXP02FWYSD.13.53.E09.1.454.CMB.2.raw
  modified_base (349)..(349): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcgaggcaacgccccgaactcctgatctacggtacatccactttgcacgtagtgggactcccatccaaggttcagtgacagtagntctggaaacagtactttacccncaccatcgagggtctacgagtcctagaacgttagtttgacgtacttactattacgtacaactagtacgtttacccttccgtacccccggtacgttcggaccgaacgggaccaaggtacgaaactacgaacgacgaacgtagtacggctcgacacaactcgtcgtacttcacttaccgtccgtacc

SEQ ID NO: 365178 - DNA, 603 bp, Homo sapiens
  misc_feature: GZ8MTXP02JJG26.13.53.E09.1.454.CMB.2.raw
  modified_base (318)..(318): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaatggtatcagcagaagtcagggcaacgccccgaacctcctgtatctaacggtacatcctactttgctanagtgggactccatcctaagttcagtggcaagtagatcgtaggaacgtagtaacttttacccactaaccctattcgacggggttccaacgtacgtccctagtaacgtatttcgacgtacttacgtattcgtactaaactagtaacgtttacccgttaccgtacccccggtacgtaccggtaccgaaacgggtaacccggtaaaggtacgaaaacgtacaaacggacgtaaccggtgtacggcgtacggccaaccaacgtactcgttctctaacttcgtcccttacc

SEQ ID NO: 365179 - DNA, 568 bp, Homo sapiens
  misc_feature: GZ8MTXP02FR674.13.53.E09.1.454.CMB.2.raw
  modified_base (354)..(354): a, c, t, g, unknown or other
  modified_base (377)..(377): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaacctctgactctacggtacatccctactttgcacgtaggtgggactcccatccaaggttcagtggcagtagntcaggaaactagtactttacccncacctatcgagggtctacacgtcctagaagtattttcgacgtacttacttattcgtacaaacgtagttacgtttacccttccgttacccccggtacgttaccggaccgtaacgggaaccgaaggtacggtaaactacgaagtacgaacgtgtacggctacgcacaactcgtctctactactcctccgtacc

SEQ ID NO: 365180 - DNA, 561 bp, Homo sapiens
  misc_feature: GZ8MTXP02HGCA9.13.53.E09.1.454.CMB.2.raw
  modified_base (349)..(349): a, c, t, g, unknown or other
  modified_base (372)..(372): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgccgtctctcggagacagggtcaccatcatttgcggcaagtcagaacattggacaactctttaaattggtatcagcagaagtcagggcaagccccgaactcctgatctacggtacatccactttcgcacagtgggactcccgatccaaagttcagtggcagtagntctaggaacagtacttttacccncaccatcgaggggttctaacgagcctagaagtattttgacgtacttactatttcgtacaactagtactttacccttcccgtcccccggtacgttcgccgaaagggacccgaaggtagaaaactacgaaagcgaacgtagttcggctacggccacctaacgtctacgttactactactccttccccgtcc

SEQ ID NO: 365181 - DNA, 565 bp, Homo sapiens
  misc_feature: GZ8MTXP02IXTQK.13.53.E09.1.454.CMB.2.raw
  modified_base (288)..(288): a, c, t, g, unknown or other
  modified_base (341)..(341): a, c, t, g, unknown or other
  modified_base (346)..(346): a, c, t, g, unknown or other
  modified_base (548)..(548): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctccngatctacggtacatccactttgcacagtgggactccatccgaagttcagtgcngtagntctaggaacagtactttacctacacccatcgaggggttctacgacgcctagaacgttatttttgaccgtaacgtttattattgtactaaactagtacgtttaccttaccctcccccgggtacgttaccggccgaaacgggaccaaagggtacggaaaactacgaagacgaaactggtacggctcgcacaatcttcgtacttnacttccgttcccgtacc

SEQ ID NO: 365182 - DNA, 599 bp, Homo sapiens
  misc_feature: GZ8MTXP02HNEOQ.13.53.E09.1.454.CMB.2.raw
  modified_base (289)..(289): a, c, t, g, unknown or other
  modified_base (350)..(350): a, c, t, g, unknown or other
tcagtcacgtactacacgaccggtgctcgatttagagagagtgtgttgggtttgggggagtcagtctcagtcaggacacagcatggacatgagggtcccccgctcagctcctggggctcctgctactctggctccgaggtgccagatgtgacatccagatgagccagtctccatccaccctgtctgcgtctctcggagacagggtcaccatcacttgtcggcaagtcaagaacattggactaactctttaaattggtatcagcagaagtcaggcaacgccccgaactcngatctacgacatccatttgcacagtcggatcccatacccgaaagttcaggtgacgagtagntacgtagaaactagtacttttaccacaaccagtacgaagggtctacgacgtccgtagaagttactttacgacgtacttacttaagttcgtacaaacgtagtacttacccgttccgtacccccggtacgttacggaccgaacgggaaccgtaagggaacgtaaacgtaaccgaaacgtacgtaaacgtacggtacgtcgacgtaccacctaacgttcgtacgttccttacgtaccttaccgtaccctacg

SEQ ID NO: 365183 - DNA, 534 bp, Homo sapiens
  misc_feature: GZ8MTXP02GMOV0.13.53.E09.1.454.CMB.2.raw
  modified_base (365)..(365): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagagtcagggcagccccgaactcctgatctacggtacatccactttgcacagtggatcccccatcaagtcagtgcagtgatcgtagaacagtactttacccnaccatcaggggtctacgagcctgaacgtatttgacgtaactttactattgtacaactagtacgttacccttccgtacccccggtacgtttccggaccgaagggaaccgaaggttacgggaaaatcgaaagcgaaactggtacggactgctaccactctgtctcacttcc

SEQ ID NO: 365184 - DNA, 671 bp, Homo sapiens
  misc_feature: GZ8MTXP02GH04T.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaactagttcggactaacttctttaaagttggtatcagcagaagtcgagggccaacgccccgaactcctgactcgtaaccggtacactcctacgtttgaccgtacgaggtacgggacctcccagtacccgtaagggtttccagggttacggctaaggttagacttacgtaggtaaacctagttacctttaacccacctaacccgtacgtccggtaacggggttcctaacgacgtacccgtagtaagttattttcggacttaacttaccttaagttactaactacgtaacgttaccgttaccccgtttcccgtaccccccgggttaacggttccggaaccggtaaaccgggtacgaacgggtaacggaaacttacgaacgacgacgtaggtcgtacgtacgaccactaacgtcgttacgttccttctactcccgttccgtaccc

SEQ ID NO: 365185 - DNA, 638 bp, Homo sapiens
  misc_feature: GZ8MTXP02JNL5O.13.53.E09.1.454.CMB.2.raw
  modified_base (366)..(366): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtcttcgtctctcggagacagggtcaccatctacgttggtcgggacaagtcagaactagttggactaacttctttaaattggtatcagcagaagtcgaggacaacgccccgaacctctcgactctaacggtacactcctactttgcacgagtggactccatcgaagttcagtgacagtagntctaggaacagttactttaccacactagtcgacgggtctacgacgtccgtagaacgttagtttacgacgttaactttacgtagtttactacctaaacgtacgttaccgtttacccttacccgttacccccgggtaacgttccgggaaccgtaaaccgggtaacccgtaagggtaacgtaaaacgtaccgtaacggaaccgtaaccgtacgggtacgtaacgtcggaacctaacgtacttcgtacgttcctaccgtacttcccgtttaccccg

SEQ ID NO: 365186 - DNA, 658 bp, Homo sapiens
  misc_feature: GZ8MTXP02H08D9.13.53.E09.1.454.CMB.2.raw
  modified_base (404)..(404): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccacctgtctgcgtctcgtcggagactagggtcacctatctacttggtcgggacaaggtcagaacattggctaactcttaaattggtatcagcagaagtcagggacaacgccccgaactccgtgactcacggttacaactcctactttgacacgtagtggactccccataccgtagttaccaggttcggactaggttagaatccgtagaactacgtacttttacccncacactcgtaagggttcacgtacgtccgtagtaggtaattttcggacttaacctttattatttacgttacaaacctaggtaccgttaaccctttcccgtacccccggttaacggttccggtaacccgtaacggggtaacccgaaacgggttacgaaaaagtttcgaaacgtaacccggaaacgtttacggggtacgtacgtacgtaaccgtaccgtaccgttacgttacgttaccgtttaccttaccgttcccg

SEQ ID NO: 365187 - DNA, 575 bp, Homo sapiens
  misc_feature: GZ8MTXP02HUL88.13.53.E09.1.454.CMB.2.raw
  modified_base (352)..(352): a, c, t, g, unknown or other
  modified_base (375)..(375): a, c, t, g, unknown or other
  modified_base (405)..(405): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagcccccgaactcctgatctaacggacatccactttgacacagtgggactcccatcccaaaggttcaggtggcagtagntctaggaacagtacttttacccncaccatcgaggggtctacagcctagaactnttttgacgtactttaatattgtacaaactagtactttacccttcctaccccgggtacgttcggaccgaacgggaacccgtaaggtacgggaaaactacgaaacgacgaaacgtgtacggtccgcgtccaacctaagtacctcgttacttactacttcctttaccccgacc

SEQ ID NO: 365188 - DNA, 589 bp, Homo sapiens
  misc_feature: GZ8MTXP02H2OUW.13.53.E09.1.454.CMB.2.raw
  modified_base (355)..(355): a, c, t, g, unknown or other
  modified_base (376)..(376): a, c, t, g, unknown or other
  modified_base (395)..(395): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaactattggacaacttctttaaattggatcagcagaagtcagggcaacgcccccgaactcctgatcctacggtacatccctactttgctacaggtggactcccatcccgaagttcagtgcagtagntcaggaaacagtactttaccncacctatcgagggtcctanacgtccgtagtaagtagtttttgacgttaacttactaatttcgactaaactacgttaacgtttaccctccccgtaccccccggtacgtttcggaaccgaaacggggacctaaacgggtacggtaaataccgaagacgaaacgtggtacggcttacggccctacgaattcgtacgttctcacttccttccccgac

SEQ ID NO: 365189 - DNA, 620 bp, Homo sapiens
  misc_feature: GZ8MTXP02GK9BO.13.53.E09.1.454.CMB.2.raw
  modified_base (232)..(232): a, c, t, g, unknown or other
  modified_base (345)..(345): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacnttggcaactctttaaatggtatcagcagaagtcagggcaacgccccgaactcctgatctacggtacatccactttgcacagtggatcccataccaaggttcagtgacagtagntcgaggaaactagtactttaccacaccatcgagggtctacagaccctagaagtatttcgacgtactttaactattcggtacaacgtagtacgtttaacccttccgtacccccggtagttccggtaccgaacgggacccgtaagggtaacgggaaaacttacgaaaacggtaccgtaaacgttacgggtacggtaccgttacgaccgtaacccgtaacttaccgttcggtttacccgttaccgttaaccgtttacccctttccccggttaaccccg

SEQ ID NO: 365190 - DNA, 711 bp, Homo sapiens
  misc_feature: GZ8MTXP02F4UHP.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaactactttaaattggtatcagcagaagtcaggcaacgccccgaactcctgactcgtacgtacactcctactttgccagaggtggactcccatacccgtaaggttcagtcggactaagtagtatcgtaggaaactagttaacctttaccccactaaccctagtaccgtaacggggttcctaacgacgtacccgtaaggtaaacgttagttttacggaccgttaaacctttaacttaacgtttacgtaacgtaaaccgttaacggttaaccgttttaacccccgtttacccgttaacccccccggggttacggtttacccgggtaacccggtaaaacggggtaaccgtaaaacgggggttaaacgaaaacggttaaccgaaaacggtaaccgtaacggttacggtacgggtactacggcctaaccaacgttccgttacgttccttacctaccttaccccgttacccgtaccc

SEQ ID NO: 365191 - DNA, 820 bp, Homo sapiens
  misc_feature: GZ8MTXP02IUR1R.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggcaagtcagaacattggctaacttactttaaattggtatcagcagaagtcagggacaacgcccccgaacctcctgactcgtacggtacatcctactttcgacacaggtcggactaccccgtataccgtaacggttcaaggtggacgtagtagtacgtccgtagggtaaacctacgttacctttttaaccccgacctaaacccgtacgttaccgtaacgggggttaccctaaccgtacggtacccgttaaggtaaaacggttacgttttttacggaaccgtttaaacctttaacgttaaacgtttaccggttaaacctaaaacccgtaacggtttaaacccggtttttaacccccgtttaccccccggttacccccccgggggtttaacccggttacccggggtaaccccggtaaaaccgggggtaacccccgggtaaaaggggttaacgggtaaaaacgttaacccggtaaaacgggaaacccggtaaaaccggttggggttacccgggtaccgttaaccgggtacccgtaaaaccccgtaacgttcccgtttaccggtttaccctttacccgtaaccctttcccgtttacccccgtacccg

SEQ ID NO: 365192 - DNA, 590 bp, Homo sapiens
  misc_feature: GZ8MTXP02IE2TB.13.53.E09.1.454.CMB.2.raw
  modified_base (362)..(362): a, c, t, g, unknown or other
  modified_base (384)..(384): a, c, t, g, unknown or other
  modified_base (401)..(401): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccacctgtctgcgtctctcggagacagggtcaccatcacttgtcgggacaagtcaagaactattggacaaactctttaaattggtatcagcagaagtcagggacaacgtccccgaacctcctagatactacggtacatcctactttgcaactaggtcgggatcccataccgaagttcagtgcagttagntctaggaacagtaactttaccncacatcagggtctacanctataaatttgacgtattactatcgtataaacagttaacgtacctttaccgtcccccggtagtaccgtaccgaaacggtaccgaaaaggtacggtaaaacgtacgaaacgaccgtaaacgtaggttacggacttacgcgtaaccacgttaacgtcgttacgttcctaactccgttaccctacctaaccg

SEQ ID NO: 365193 - DNA, 588 bp, Homo sapiens
  misc_feature: GZ8MTXP02IB9R8.13.53.E09.1.454.CMB.2.raw
  modified_base (549)..(588): a, c, t, g, unknown or other
tcagtcacgtactacacgaccggtgctcgatttagagagagtgtgttgggtttgggggagtcagtctcagtcaggacacagcatggacatgagggtcccccgctcagctcctggggctcctgctactctggctccgaggtgccagatgtgacatccagatgagccagtctccatccaccctgtctgcgtctctcggagacgagggtcaccatctacgttggtcgggacaaggtcaagaaactagttggactaaacttactttaaaagttggtatcagcgaagaagtcgaggacaacgacccccgaacctcctgactcctaacggtactactcctactttggacctaacgtacggtacggggtaacctaccccgtaagttaaccccgtaaaacggggttttaccgaacggggttacgggtaacccggtaagggtttaaacgggtaaccgttttccggggtttaaaaaccgggggtaaaaaccccgtttaaaaacccggggggttttttaaaaacccccccctttttttttttttaaacccccccccgggnnnnnnnnnnnnnnnnnnnnnnnnnnnnnnnnnnnnnnnn

SEQ ID NO: 365194 - DNA, 726 bp, Homo sapiens
  misc_feature: GZ8MTXP02I9CK4.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacgagggtccaccatcacgttggtcgggacaagtcaagaactagttcggactaaacttactttaaattggtatcgagacaagaagtcgaacgggcaaccggcccccgtaacctcctgaacttccgtaacggtacctactccctatttcgacctacgtaaggtcgggaacctccccgtaatacccgtaaagggtttccaaggttcggactaagtagtctacgtaggtaaacctagttaccttttacccacaccctaagtcgtaacggggttactaacgacgtaccgtaagtaacgttagttttacggacttaacctttacgttacgttacggtaaacctaaaccgtagttaacccgttttaccccgttacccccggtacccccggttacggtacccggtaaccgggtaaaccggtaaccgaagggttaacgaaactaacggaacggtacgtaaacgtcggtacggtacctacggaaccctacaacgttcgttaacgtccttaacctccgtttaccctcccgttaaccg

SEQ ID NO: 365195 - DNA, 596 bp, Homo sapiens
  misc_feature: GZ8MTXP02IFKSR.13.53.E09.1.454.CMB.2.raw
  modified_base (232)..(232): a, c, t, g, unknown or other
  modified_base (288)..(288): a, c, t, g, unknown or other
  modified_base (371)..(371): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggttccagatgtgacatccagatgagccagtctccatccaccctgtctgcgtctctcggagacagggtcaccatcacttgcgggcaagtcagaacnttggacaacttctttaaatggtatcagcagaagtcagggcaacgccccgaactccngactctacggtacatcctactttgcacagtggactcccatcaagttcaggtcgacagtagatcgtagaacagtactttacccncacatcgagggtcctagcgactagtaagttagttttcgacgtactttactatttacggtactaaacgacgttaacgtttacccttacccgttcccccgggacgttccggtaccgaacgggtaaccgtaaaggtacgtaaacgtaacgtaaacggacgtaaccgtagttcgggacttcggaccgtacctactcgttcttacttctacttcccggtttccaccctac

SEQ ID NO: 365196 - DNA, 625 bp, Homo sapiens
  misc_feature: GZ8MTXP02G0T8Y.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacaggtcaccatcacttgtcggcaagtcagaacattggactaacttactttaaatggtatcagcagaagtcgagggcaacgccccgaactcctgactcgtaacgtacatccgtactttgactacgaggtgggtactccccatccccgtaaaggttcaaggtcggactaggtagcttcgtaggaaactacgtaccttttacccacaacctagtcgaacgggttctaacgagtccgttagaagttattttcggacttaactttactaattgtaactaacgtagtaccgtttacccgtacccgtacccccggtagttccggaccgaacgggtaccgtaaggtacggaaaactacgaaacgacggtaaacgtggtacgtacgtcgacctactaagttcctacgttcttccgtacgttcccgtttaacccgtc

SEQ ID NO: 365197 - DNA, 674 bp, Homo sapiens
  misc_feature: GZ8MTXP02I61LB.13.53.E09.1.454.CMB.2.raw
  modified_base (277)..(277): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattgcatacttaatgtatcagcagaagtcaggcaagccccgaactcngatctaacggcatcctaactttgctacagtcgggactccccgatcccgtaaacgttcgaagtcgggacaacggtaagattccgtaacgggaaactacgttaactttttacccccgtactaaacccgtacgtacgtaacgggggtaccttaaacgacgtacccgtaaggaacgttagtttttagaccgtactttactaaacgtttcgtaactaacgtaagtacctttaaccgttccccgtacccccggtacggtttaccgacccggtaaaacggggacctaacgggtacgtaaaactaccgaaaggtaccgaaacgttacggtaacggtccgttacggacccgaaccgtaaacttccgttacggttaaccttctaaccttacccgtttccccgtaacc

SEQ ID NO: 365198 - DNA, 563 bp, Homo sapiens
  misc_feature: GZ8MTXP02GXIGX.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacatggcaactcttaaatggtatcagcagaagtcagggaccaagcccccgaaactccctgatctacggtacatccactttgcacagtggactcccccatcaaggttcagtggcagtagatcgtagaacagtactttaccctacaccatcgagggtctacagcctgaagtatttacgcgtacttactattcgtacaactagtacgtttaacccttccgtacccccggtacgttcggaccgaacgggtaacgaacggtacggaaactacgaacgacgtaaccgtggtacggcttacggaactaccgtactactcgtcttactactttacccg

SEQ ID NO: 365199 - DNA, 743 bp, Homo sapiens
  misc_feature: GZ8MTXP02I0VPC.13.53.E09.1.454.CMB.2.raw
  modified_base (294)..(294): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggctaacttcttaaatggtatcagcagaagtcagggacaacgccccgaaactccngactctaacggtacatccctactttgacacgaggtggactcccccagtacgtaaggttcaggttggactaggtacgaagtccgtagggaaactagttaacctttttaccccacctaacccgtaagttaccggaacgggggttacctaaaccgtacgtacccgttaaggtaaacgttaacgttttcggaccgtttaaacgtttaaaccctttaagtttacggttaaccttaaaccgttaacgggtttaaaccgttttacccccgtttacccggtaacccccccgggttaccggtttacccggggtaaaccccgtaaaacgggggtaaaccccgtaaaaggggttaacgggtaaaacgtttaaccgaaacggaaccggttaaaccgttaggtacggtcgttacggaacctaaccggtacttacgtcgttacctttcgtaacgtttcccccg

SEQ ID NO: 365200 - DNA, 575 bp, Homo sapiens
  misc_feature: GZ8MTXP02FVTMX.13.53.E09.1.454.CMB.2.raw
  modified_base (343)..(343): a, c, t, g, unknown or other
  modified_base (346)..(346): a, c, t, g, unknown or other
  modified_base (366)..(366): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactctttaaattggtatcagcagagtcaggcaacgccccgaactcctgatctacggtacatccactttgcacagtggatcccatccaagttcagtgcagtagntcnggaaactagtactttacccncaaccatcgagggtctacacgtcctagaagttatttgacgttacttacttattacgtactaacgtagtacgtttacccttaccgtacccccggtacgttaccggaccggtaacgggaccgtaaagggtacggaaactaacgaagacgtaaacgtggtacggcgttacgaccacctaattacgtcgttcttactacttccttcccgtacc

SEQ ID NO: 365201 - DNA, 602 bp, Homo sapiens
  misc_feature: GZ8MTXP02H4VSB.13.53.E09.1.454.CMB.2.raw
  modified_base (341)..(341): a, c, t, g, unknown or other
  modified_base (365)..(365): a, c, t, g, unknown or other
  modified_base (586)..(586): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcaggcaagcccccgaactcctgatctacggtacatccactttgcacagtggatcccatccaagttcagtgcagtanatctaggaaacagtactttacccncaccatcgaggggtctacgacgtacccgtgaaaggtacttttgaccgtacttaactattcgtactaaacgtagtacgtttaacccttcccgtaccccccgggtacggtttaccggaccgtaaacggggtaacctaaacggggtacggtaaaagtaccgaaaaggccgtaaaaccgtcgtcggggacctacggacctaaccaagttcctacgttccttaccnctttcctaccccgtcc

SEQ ID NO: 365202 - DNA, 566 bp, Homo sapiens
  misc_feature: GZ8MTXP02FQNR0.13.53.E09.1.454.CMB.2.raw
  modified_base (344)..(344): a, c, t, g, unknown or other
  modified_base (368)..(368): a, c, t, g, unknown or other
  modified_base (534)..(534): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagagtcaggcaagccccgaactctgatctacggtacatccactttgcacgagtggactcccataccaaggttcagtggcagtagntcgtaggaacagtacttttacccnaacccatcgaggggtctaacacgtccttagaaacgttattttgaccgttaacttacttattagtacaacgtaagtacgtttaccctccgtcccccggaccgttacggaccgtaacgggaccgtaacgaacggtaagtaacgagacgacgtacgttcggacgtaccncgactcgtacgtctacttctcctccgtactac

SEQ ID NO: 365203 - DNA, 558 bp, Homo sapiens
  misc_feature: GZ8MTXP02JUK1Q.13.53.E09.1.454.CMB.2.raw
  modified_base (321)..(321): a, c, t, g, unknown or other
  modified_base (341)..(341): a, c, t, g, unknown or other
  modified_base (365)..(365): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttgtcggcaagtcagaacattggcaactcttaaatgtatcagcagatcaggacacgccccgaactcctgactctacggtacatccactttgcacagtggactcccanccaaggttcagtggcagtantcgtaggaactagtactttacccncacctagtacgacggggtactacgagccctagtaacgtgttttagctaacttatagttcgtacaactaagtacgtttaaccctccgttacccccggacgtttaccgaccgtaacgggacctaagggtacgaaatacgaaaggacaacgtcgtacggctacgcactaacgtcgtctacttcactccttccaccc

SEQ ID NO: 365204 - DNA, 621 bp, Homo sapiens
  misc_feature: GZ8MTXP02J13F9.13.53.E09.1.454.CMB.2.raw
  modified_base (197)..(197): a, c, t, g, unknown or other
  modified_base (356)..(356): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacgagggtcaccatcacttggtcggcaagtcaagaacagttggactaactctttaaatggtatcagcagaagtcgagggacaacgccccgaactcctgactcacgtacactcctactttgcacgagtggactccatccgaaggttcaagtgacagtagntcgtaggaactagtactttacccactacccagtacgacggggtactacgacgtccgtaggagttaacgtttgaccgttacttaacgtacgtttcggaactaaacgtacgttacccgtttaccgtttaccccggtacccggtaccggtttaccgggaaccgtaaacgggaacccgtaaagggtacgaaaacttcgaaacggtacaaacgttggtaccgtcgttccgactaccaatccgttattccttaacgctttccctccgtacc

SEQ ID NO: 365205 - DNA, 619 bp, Homo sapiens
  misc_feature: GZ8MTXP02IC7A0.13.53.E09.1.454.CMB.2.raw
  modified_base (373)..(373): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctcccaggtgccagatgtgccatccagatgacccagtctccatcctcctgtctgcatctgtaggagacagagtcaccatcacttggccgggcaagtcagggctattaagaaatgtagtttaggctggtatcagacaagaaaccgaagggaaacacccctaagccttacttagatctagtggtgactagtacctaaggttaaaagtcggggtaccctagtacgacgtcgagcggacgagtaggntcgtgggcacgagtacttcattctaccaccatacgacgacagccctggaccagccgtagtaacgttatttacgaccttaaatttacttaatcgtaacttaaccaagtactacctaaataagttacgtaccgttacggggtaacgtttacgggaacccggtaaagggtaaccgtaaaagggtacgaaaacgttaacgaaaacggtaacgttacggtacggttacacgtacctaacgtactttaccgg

SEQ ID NO: 365206 - DNA, 714 bp, Homo sapiens
  misc_feature: GZ8MTXP02F4BLL.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatctacttggtcgggacaagtcaagaactattggactaacttactttaaattggtaatcagcagaagtcgaggcaacgccccgaactctagactacgtacgtacactccctactttgacaacaggtacggtactaccccaagtcctaaaggttccaaggtcggacgtagtagacttacgtaggaaacctacgttaaccttttaccctactaaccgtacttacggtaacggggttaccttaaacgacgtcccgttaaggtaaacgttagttttaccggaactttaaaccttttaccgtaatttacgttaaacgtaaacgttaaacgggttaactttaaccccccgttcccggttaccccccgggtaggtttaccccggaccggtaaacggggtaacccgtaaagggttaacgaaaacgtacgtaaacgtaccggtaaacgtaccggtaggtcctaggaaccctaaccgtattacccgtcgttaccttccgtactttcccccg

SEQ ID NO: 365207 - DNA, 658 bp, Homo sapiens
  misc_feature: GZ8MTXP02II7EE.13.53.E09.1.454.CMB.2.raw
  modified_base (332)..(332): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgttctctcggagacgagggtcaccatcacgttgtcgggacaagtcaagaacattggactaacttctttaaattggtatcagcaagaagtcgagggacaacgcccccgaactcctgactactaacggtacactcctactttgccanagtggactccatcctaagttcagtggacagtagctcgtaggaaactagttaaccttttacccactaccattcgaagggtcctacgagtccgtagaaacgttattttacgacgtaactttacgtatttcgtacctaaagtacgttaacgtttaccccgttaccgtacccccgggtacgtttaccggtaacccggaaaccgggggtaaaccgtaacgggtaaacggaaaacgttaacggaaacggtacgtaaaccgttggtacggtacgttcgaccgtaacccgaatttccgtcggtttaccttacgtcctaccgtttccccgtaccg

SEQ ID NO: 365208 - DNA, 737 bp, Homo sapiens
  misc_feature: GZ8MTXP02ILSGB.13.53.E09.1.454.CMB.2.raw
  modified_base (232)..(232): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctcatccacctgtctgcgtctctcggagacagggtcacatcacttgtcggcaagtcagacnttggcatacttaatggtatcagcagaagtcgaggaccaagccccgaacctcctgactcgtacggtaacactaccctacttttgacacgacggtagggacttccccctaatccgtaaacgggtttcaacgggtttggacctaaggggttacgaagtttaccgttaacgggtaaaccgtaaggttaaccttttttaaacccccgacctaaccgaacgtttacgaacgggggttcttaacccgagtacccgttaagtaaaggtttacgtttacgacggttaaactttaaccgtttaatttacggttaacctaaaccgtaaggtttaacccgtttaaccccgtttcccgttacccccggggtaccggtttaccgggaacccgtaaacggggtaaccccgtaaaagggttaacggaaacgttaaacggaaacgtacggaaaaccgttcggacggtacgtacggaaccgtaacctacgttacctacggtttcctactaacgttttcccccg

SEQ ID NO: 365209 - DNA, 575 bp, Homo sapiens
  misc_feature: GZ8MTXP02G0LPD.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaactactttaaattggtatcagcagaagtcagggcaacgccccgaacctctgatctacggtacactccactttgcagagtggactccatccaaggttcaggtggactaagtagattcgtaggaaacagttactttaccctacaccatcgagggtactacgagtacctagagtactttgacgtacttattatagtactaactagttacttaccgttacccgtaccccggtagttaccggtacgaaacgggtacccgaaaggtacgaaacgtacgaacgacgaacgtacgaggtacgacgtcacctaactctacgttactctacttccgtacgtaccc

SEQ ID NO: 365210 - DNA, 551 bp, Homo sapiens
  misc_feature: GZ8MTXP02FR8BQ.13.53.E09.1.454.CMB.2.raw
  modified_base (237)..(237): a, c, t, g, unknown or other
  modified_base (353)..(353): a, c, t, g, unknown or other
  modified_base (409)..(409): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacntggactaactcttaaattggtatcagcagaagtcagggcaacgccccgaacctctgactctacggtacatcccactttgacacagtggactccccatcaaggttcagtggcagtanatcgtagaactagtactttacccacaccatcgagggtctacgacgcctagaagttntttagacgtacttactattacgtacaactagtacgttacccttccgtaccccgtggtaccgttcggaccgaacgggaccgtaaggtagaaactcgaaaggtcaaacgtgtacgcgtgaccactacttctcgtcttactaccg

SEQ ID NO: 365211 - DNA, 623 bp, Homo sapiens
  misc_feature: GZ8MTXP02I92A0.13.53.E09.1.454.CMB.2.raw
  modified_base (369)..(369): a, c, t, g, unknown or other
  modified_base (395)..(395): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaaccatcacgttgtcgggacaaaggtcaagaacagttggactaaacttctttaaaattggtatcaagcagaagtcaagggcaacggccccgaacgtcctagatcgaacggtacatccaactttgcagagtggactcccgataccaaggttcagtggcaagtagntcgaggaaactagtaacttttacccncacaacgtcgaaggggtctaacgacgtacctagtagtatttgacgtaacttattatacgtacaaacgtagtaacgtttacccgtaccgttacccggaccgtttaccggacgaacgggtaacgaaacgggttagaaaacgttacgaaacgacgaaaccgttagtacggtactacgaccgtaaccaacgtaccttacgttacgttcctaacttcccgttacccgtacccg

SEQ ID NO: 365212 - DNA, 751 bp, Homo sapiens
  misc_feature: GZ8MTXP02JELUE.13.53.E09.1.454.CMB.2.raw
  modified_base (348)..(348): a, c, t, g, unknown or other
  modified_base (390)..(390): a, c, t, g, unknown or other
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtccaccgatccacgtttggtccgggacaagtccaagaacagttggacaaacttacttttaaagttggttaatcgagtcaaggtaagtacgaggaccaacgcccccgaacctcctgactcgtacgtacactcctatttcgacanaggtcggtactcctataccgtaaggtcacgtggctaaggtanacgtctaggaactacgttacttttacccctcgaaaccctagtaccggtaacgggggttaccctaacggtacgtacccgttaagtaaacgtttaacggtttttacgaccgggtttaaactttacgtttaaatttacgggttaactaaaccgttaacgttaaccggttttaccccgtttccccggtaacccccgggttacggtttaccggacccggtaaaaccgggtaccggtaaacgggtaacggaaaacgttacggaaaccggaacggtaaaccgtagggttcggaccgtttacggcccttaacctaacgtttaccgtcggtttacttccgttacccttacccgtttccccggttaaaccg

SEQ ID NO: 365213 - DNA, 722 bp, Homo sapiens
  misc_feature: GZ8MTXP02JAYPB.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacgagggtcaccatcacttggtcggacaagtcaagaacattggactaacttactttaaagttgtatcagacgagaagtcgaggggaccaaccggacccccgtaaccgtccgtacgtactaccgtaaccgtactactaccgttacgttacgacctaacgtacggtcggtacctaccgtaagtacccgtaagttaccgaggtacgtacgtaaggtacgtcgtacgtaacggtaaacgttacgttaaccctttaaccctaccaaccgttacgtccggtaaccggttactaacgtacgtacgtaagtaagtttacgttacgtaacgtttaactacgtttaagttaccgtaaactaaccggttaacgttacccgtttaacccgtccccggttaccccggtacggttacccggaaccggaaacggaaccgtaaagggtaacgaaacgtaaccgaacgtaacgtaccggtagtcgaccgtacgaccgaacttaagttaccgctttacgtacctccgttacccgcctaaccg

SEQ ID NO: 365214 - DNA, 867 bp, Homo sapiens
  misc_feature: GZ8MTXP02H45MX.13.53.E09.1.454.CMB.2.raw
  modified_base (275)..(275): a, c, t, g, unknown or other
tcagtcacgtactacacgaccggtgctcgatttagagagagtgtgttgggtttgggggagtcagtctcagtcaggacacagcatggacatgagggtccccgctcagctccgtggggctcctgctactctggctccgaggtgccagatgtgacatcagatgagccagtctccatccacctgtctgcgtctctcggagacgagggtcaaccatcacgtttggcgggcaaagtcaaggaactattggactaaactctttaaattggaatcagcagaancgaggcaaagcccccgtaaactccgtagtactacgtaacggtaacactcctaactttgacctagtacggtacgggaactccccaagtaccccgtaaaaggggtttcaacgggttcggggactaaggttaagggacttaccggttaaaggaaaaccttaaacggttaaccttttttaaacccccccataaaacccccgtaagtttacccggaaagggggttaccttaaacccggtaagaccccgttaaaggttaaaacggtttaagtttttttaccggaaaccgggtttaaaccccgttttaaacgttaaacgttttaaggtttaaacccaaaaccgttaaagggttaaaccgtttttaaaccccctttccccggttaaccccccggggtaacgtttacccggggaacccgtaaaacgggggtaaacccccgaaaacgggggttaaggggtaaaaaactcccggtaaaaaagtcccggggaaaaaacccttttcgggtaaaggggccctttaacgggaccgaaaccccgtaaagtttccgtaacgtttacccgttcgtttaaacgttacccccggtttttaccccccgacccg

SEQ ID NO: 365215 - DNA, 714 bp, Homo sapiens
  misc_feature: GZ8MTXP02IFC9E.13.53.E09.1.454.CMB.2.raw
  modified_base (220)..(220): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggnaagtcagacattggactaacttctttaaattggtatcagacagaagtcgaggaccaacggaccccgaacctccctagacttacgtaacggtaccacttaccctacttttcgacctaacgtaggtacggggtactaccccgtataccccgttaaacgggtttccagggttacggacgtaaggttaacgtacgtttcgtaaagggtaaacctacgtttaaacctttttaccccgactaacccgtaacgttacggacgggggtttacctaaccgaagtacccgttaaggtaaaccggtttattttacggaccggttaacttaccttaagtttacgtaacctaaacgtacgttaacccgtttaacccgttcccgtacccccgggttacgttaccggaccgtaaacggggtacccaaagggggtacgaaacgttacgaaacgtacgaacttaggcgtcgtacgcctaacaatccgtagttctactactcctacccgtac

SEQ ID NO: 365216 - DNA, 662 bp, Homo sapiens
  misc_feature: GZ8MTXP02GSGU4.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggacaagtcagaactagttggactaacttctttaaattggtatcagcagaagtcgagggcaacgccccgactctgactcgtacgtacatcctactttgcacgtaggtcggactccctaatccgtaagttcgaggtggacagttagcgttacgtacggaactacgttaacttttaccccgctaaacctagtaccggagggtttaccaacgagtcccttaggaaacgttgttttacggaccgttactttaacttagtttacgtactaaacgtacgtttaccgtttaaccccgtttcccgacccccgggttagtttccgggaacccgtaaacggggtaacgtaagggtaacgaaaacttacggaaaccggtacgaaacgttcggtacgtacgtacaccgtaccaacttacgtccgttacttacgtactttcccgtaaccctttcc

SEQ ID NO: 365217 - DNA, 767 bp, Homo sapiens
  misc_feature: GZ8MTXP02ITNVQ.13.53.E09.1.454.CMB.2.raw
  modified_base (199)..(199): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatggtgacatccagatgagccagtcctccatccaccctgtctgcgtctctcgganacgaggtcaccatcacgttgcgggacaagtcagaacagttggactaacttactttaaattggtatcgaagctagaagtcgaagggacaaaccgaccccgaacctcctacgaacttaccgtaacggtaacctacgttacctaaccgttttcgaaccgtaacgtaacggtacggggtaacctaccccgtaacttaccccggtaaacggtttcgaacggttacgggacttaaaaggtttaaagccgtttaacggggtaaacgtaaaccggttaacctttttaaacccgtttacccaccgttaaccgttaccggttacgggtaacggttaccgtagaccgttacgttaagttaacgtttagttacgtaccgttacgttaactttacgttaaccgtaacgtaacgtacgtttacccgttacccgttaccccggttaccccggtacggttaccggaaccggtaaccggaacggtaacgttaacggaaacgtaacggacgtaaacgtacggtacgtacgtacggtacacgtactaaccgttactcgttacctactcccttaccggttaccctacc

SEQ ID NO: 365218 - DNA, 703 bp, Homo sapiens
  misc_feature: GZ8MTXP02GKXUJ.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtccaccatcacttggtcgggacaagtcagaactagttggactaacttactttaaagttggtatcagacagaagtcgaggcaacgcccccgtaacctcctagactacgtaacggtacactcctaactttgacacgtaggtaggtacctcctataccgtaaggtcaggtcggactagtagcgtcgtacggaaactagttaacctttacccacaacccgtagtaccggtaacggggttacaacggtacgacccgttaaggtaacgtttagttttacggaccttaactttacgttagttaccgtaactaacgttacgttaaccgtttaccccgttacccgttaccccccgggtacggtttacccggaacccgggtaaaacgggtaacccggtaaaggggtaaaccgtaaaacgttaacggaaaacggtaccgtaaacgtacgggtcgacgtcacgtactaacgtcgtacgttacttaccgtaccgtttacccgtctaaccg

SEQ ID NO: 365219 - DNA, 691 bp, Homo sapiens
  misc_feature: GZ8MTXP02I69G3.13.53.E09.1.454.CMB.2.raw
  modified_base (200)..(200): a, c, t, g, unknown or other
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtcctccatcccacctgtctgcgtctcgtcgganacgacgggtcaccatcacgttggtacgggactaagtcaagaactagttcggactaacttactttaaaagttggtaatcaagcaagaacgtcgagggaccaaccgacccccgaaccttccgagtactccgtacgtacactcctactttgacacgaggtcggactaccctataccgtaaggttcaggtacgacgtaggtaactcgtcgtaaggaaacctacgttaaccttttaacccgactaaaccgtacgtacggtacggggtacctaacgacgttaccgtagttaaacgttacgttttacgaacttaaccttatttacgttacgtaaccaaacgttacgttaccgtttaccccgttaccgtacccccggtacgtccggtaaccgaaacgggaccgtaaagggaacgaacgtacgaacgtaacgtaccggtaggtacgtccgtaccgtacaaccgtcttacgtcttacgtacctaccttaccgtaccctccg

SEQ ID NO: 365220 - DNA, 810 bp, Homo sapiens
  misc_feature: GZ8MTXP02GOVV3.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtccaccatcacgttggtcgggacaagtcaagaactagttggactaacttactttaaagttggtatcgagcgaagaagtcgacgggacaaccggacccccggacctccgtggacttccgttaccggtaaccacgttcctaacgtttcgactaaccggtaggtacgggtaacctaccccgtaagtaaccccgtaaacgggttacctaagggttcggggactaaggttaacggacgtttaccgttaacggggtaaaaccgttacggtttaaccctttttaacccccgtaaccggtaacccttaaccggggtaccggttaaaccgggggttaacccttaaacggacggtaacccgttaaggttaaagttacggtttttacggaacgtttaaaccctttaagtttaacgtttacggaaacctaaacggttacggttacttttaacccccgttacccggtaccccccgggtaggtttacccgggaaccggttaaaccggggaaccgttaagggtaaacggtaaactaacgaacggtaaccggtaagttgggaccgtacgtacgacccgaacttaacgttctcgttaacctcctacgttcccgtttaccgcc

SEQ ID NO: 365221 - DNA, 592 bp, Homo sapiens
  misc_feature: GZ8MTXP02GIGSL.13.53.E09.1.454.CMB.2.raw
  modified_base (283)..(283): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcattgtcggcaagtcagacattggacaactcttaattggatcagcagaagtcaggcaacgccccgaacctccngactctacggtacatccactttgacacgagtggactcccataccgaagttcagtggctagtagatctaggaactagtaaccttttacccgctaccagtccgtaggggtacctacgagccctagaacgttagtttacgacgtaacttacttattgtaacacgtaagtacgttaacccttccgtaccccccggtagttccggaccgaacggaccgtaaaggtaggaaaacgtacaacggacgtaaccgtaggtcgtactaccggtacaaccggtaacttcgttcgtccttacgtctaccgttccccgtacc

SEQ ID NO: 365222 - DNA, 560 bp, Homo sapiens
  misc_feature: GZ8MTXP02IQZTF.13.53.E09.1.454.CMB.2.raw
  modified_base (197)..(197): a, c, t, g, unknown or other
  modified_base (281)..(281): a, c, t, g, unknown or other
  modified_base (340)..(340): a, c, t, g, unknown or other
  modified_base (343)..(343): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcggcaagtcagaacattggcaatcttaaattggatcagcagagtcaggcaagcccccgaactcngatctacggtacatccactttgcacagtggactcccatccaagttcagtggctagtacntcnggaacagtacttttacccgcacctatacgacggggtctaacgagtaccctagaaagttattttcggactaccttatatttcggacaaaacgtgttacgttacccttacccgtacccccggtagttccggacctaaaggggacctaaagggtagaaattcgaagcgaactggacggctacgaccgactaagtctacgttctactactcctacccgtac

SEQ ID NO: 365223 - DNA, 678 bp, Homo sapiens
  misc_feature: GZ8MTXP02HK9CM.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctccgtggggctcctgctactctggctccgaggtgccagatgtgacatccagatgagccagtctccatcccaccctgtctgcgtctcgtcggagacgagggtccaccatctacgttggtcgggacaagtcaagaactgttggactaacttactttaaagttggtatcgagacaagacgtcgaggaccaacgccccgaacctctgactacgtacgtactactccctaacttcgacacgtaggtcggtactacccccgtagtaccgtaaggttccgtaggttccggacgtaggtaacgtacttacgtaacgggtaaaccttacgtttaaccttttaccccaccgtaccgtacgtacggtaacggggtccttaacgacgtaccgtagtaagtttacgttcgacgtttactttacttattacgttactaactacgttacctttaccccgtcccgtaccccggtacggtaccggacgaaaccgggtaacgaacggtaagtaaacgtacgaacgtacgtaacgttcgtaccgtctacggaaccactacttcgtcttacctcgttaaccttcccg

SEQ ID NO: 365224 - DNA, 708 bp, Homo sapiens
  misc_feature: GZ8MTXP02GLJG5.13.53.E09.1.454.CMB.2.raw
  modified_base (221)..(221): a, c, t, g, unknown or other
  modified_base (232)..(232): a, c, t, g, unknown or other
  modified_base (353)..(353): a, c, t, g, unknown or other
  modified_base (378)..(378): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggnaagtcagaacnttggcaactcttaaattggtatcagcagagtcagggcaacgccccgaactccctgatctacggtacactccactttgcactaggtggactccatcccgaaaggttcaggtcggacagtagnttcgaggaactagtactttaccccncaacctactcgtacggggtactacgacgtccctaggtaacgttagttttacggacgttaacgtttaacgttacgtttacgtaaccgtaaacgtaacggttaaccggttttaaccccgtttaccccgttacccccccggggttaaacggtttcccggggtaaccccggttaaaccgggggaaccccgtaaaagggggtaacggtaaaacgttaccgaaaacggtaccgtaaaccggttagggttacggtaaccgttcggaacctaacccggtaacttccgttaacggtttccctttacctaaaccgtttcccgtttacccccggttacccg

SEQ ID NO: 365225 - DNA, 669 bp, Homo sapiens
  misc_feature: GZ8MTXP02G649Y.13.53.E09.1.454.CMB.2.raw
  modified_base (197)..(197): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggacaagtcagaacattggcaattcttaaatggtatcagcagatcaggcaagcccccgaactcctagatctaacggtacattccactttgctagagtcgggactcccctataccgtaaacggttcaggtcggactagtaagactcgtagggtaaactacgtacctttttaaccccacaacccgtatacgtaacgggggttactaacgacggtacccgttaggtaaaccgtaatttttcggaccgttaaactttacttaaaggtttcgaccaaaacttggtaaaccgttttaccctacccgtaccccccggggtaatttccggaacccggtaaaggggcccgtaaaaggtacgggaactaacggaacgtacgtaaaccgtggttacggccggtaaaccgtacaaccgtaacgtcgttcgtacctttacgttacccgttacccgacttaacg

SEQ ID NO: 365226 - DNA, 733 bp, Homo sapiens
  misc_feature: GZ8MTXP02HOSP9.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgtcgtctcgtcggagacgagggtcaccatcacttggtcgggacaagtcaagaactagttggactaacttactttaaattggtatcagcaaggaacgtcgagggaccaacgacccccgaactcctgtactacgtaacggtactactacctactttgcagtaggtggtacctcccagtacccgaggttacaggtggacgtagtagattacgtaggtaaacctagttaacctttacccgactacccgagttacggacggggttacaacgtcgtaccgttaaggaacgtttagtttacggaacctttactttaacgttagtttacgtaaccgtaaacgtttacgttacccgttttaaccccggttcccccgttaacccccggggttaacggtttacccgggaacccggtaaaacgggggtaaaccggttaaaccggggtaaaggaaaaaccgttcggaaaacgggtacgtaaaccggtggttcgggaccctacggtccctaaccttaacgttaccttcggttaccttacgaccgtttccctcccggtaacg

SEQ ID NO: 365227 - DNA, 753 bp, Homo sapiens
  misc_feature: GZ8MTXP02IXYHM.13.53.E09.1.454.CMB.2.raw
  modified_base (275)..(275): a, c, t, g, unknown or other
  modified_base (305)..(305): a, c, t, g, unknown or other
tcagtcacgtactacacgaccggtgctcgatttagagagagtgtgttgggtttgggggagtcagtctcagtcaggacacagcatggacatgagggtccccgctcagctccgtggggctcctgctactctggctccgaggtgccagatgtgacatccagatgagccagtcctccatcccaccctgtctgcgtctcgtcggagacgagggtcaccatctacgttggtcgggacaagtcaagaactagttggactaacttactttaaatggtatcagnagaagtcgaggacaacgccccgaacctccngactcgtaacgtacactcctactttcgacacgagtcggactccataccgtaaggtcgaagtgacgagtagtagtcgtagggaaacttacgttaccttttaacccctacctaacccgtataccgggtaacggggttacctaaacgtcgtaacccgtaagtaacgttaacgtttttacggaccgttaacctttagtttaaacgtttacgtaaccgtaaaacgttacgtaaccgtttacccgttacccccggttacccccgggtaccggttaaccggtacccggaaacgggtaaccggtaaacgggttaaacggaaaacgtttaaacgaaacggtaccggtaaaacggtcgggttaaacggccggtaaccgtaccggtaaccgttaacttcccgggttaacgtttacccgttccgtttacccgtttaaccccgtttccccgtttaaccccg

SEQ ID NO: 365228 - DNA, 772 bp, Homo sapiens
  misc_feature: GZ8MTXP02FSQ6G.13.53.E09.1.454.CMB.2.raw
  modified_base (224)..(224): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtccaccatcacttggcgganaagtcaagactagttggacaacttactttaaattggtatcagtcaagaagtcgaggaccaacggaccccgaacctccgtgactccgtaacggtactacttccctactttcgacacgtaggtacgggactacccgtaataccgtaacggtcacggtggactaggtagtatcgtaacggaaaccttacgttacctttttacccgaccaaccgtagttaccggtacgggggttaacctaacgtaccgtaccgtaaggtaaacgtttactttacgggtaccgttaaacctttacgtttaacgtttaccggtaaacctaaacgttaaccgttaacccgttttacccccggttccccggttaacccccgggttaccggttacccgggtaacccgggttaaaccggggaaaccggtaaacgggtaaaacgggtaaaacgtttaaccggaaacggtaacccggtaaggttacgggttacggaccgttacggacctaaaccgtcgtttacgtccgtttacccttcctttaaccggttccccgttaacccgttacccg

SEQ ID NO: 365229 - DNA, 781 bp, Homo sapiens
  misc_feature: GZ8MTXP02H9HKC.13.53.E09.1.454.CMB.2.raw
  modified_base (185)..(185): a, c, t, g, unknown or other
tcagtcacgtactacacgaccggtgctcgatttagagagagtgtgttggggtttgggggagtcagtctcagtcaggacacagcatggacatgagggtcccccgctcagctccgtggggctcctgctactctggctccgaggtgccagatgtgacatccagatgacgcagtcctccatcccacctntctgctctctcggagacgaggtcaccatcacgttggtcgggacaagtcaagtaactgttacggacctaacgttacttttaaaagtggtatcgaagacaaggtaacgtacgacgggaccaaaccggaccccccgaaccttcccgtagtaccttaccggttaacccggtaacctaccgttacccttaaccgttttcgaaccgtaacgtacgggtacggggaaccttaccccggtattaaccccggtaagggtttaccgtaaggtcgggtactaacgggtaagtaccttacggtaacggtaaacctacgttaccttttaccccgaactacctacgtacggtacgggttaacctacgtacggccttaaggtaagtttacgttttacgactttacttaacgttagtttacgtaaacgtaacgttaacgtttaccgtttaccccgtttcccggtaccccccgggttaagggtttacccgggaacggtaaccggggtaaaccgtaaggggttaaacgaaaacgtacgaaaacggtacgtaaacgttgggtacgacgttcgaccactaacgttctcggttactactccgttcgtttaccccacg

SEQ ID NO: 365230 - DNA, 664 bp, Homo sapiens
  misc_feature: GZ8MTXP02I4VJR.13.53.E09.1.454.CMB.2.raw
  modified_base (261)..(261): a, c, t, g, unknown or other
  modified_base (348)..(348): a, c, t, g, unknown or other
  modified_base (354)..(354): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggcaagtcagaacattggcaactcttaaatggtatcagcagaancaggcaagcccccgaactcctagactctacggtacatccactttgcacagtgggactcccgatcccaaggttccagtggcagtacgnttacgnggtaaacctgtaacttttaccccgactacctaaactcgtaacgggggtaccttacgacgtacccgtagacgtaacgtttttacggacgttactttaacgttaattcgtaacctaaacgtagtaacccgtttacccgttacccgtacccccggtaccggttaccgggtaccggtaaaccgggtaaaccggtaaacggtaacggtaaaacgtaacgaaacggtaaccggaaacgtacggtacggtacgtacggtaccgtaaccgtaacgtaccgttacgttaccgtttaccgttacgttacccgtttccccg

SEQ ID NO: 365231 - DNA, 758 bp, Homo sapiens
  misc_feature: GZ8MTXP02JL46D.13.53.E09.1.454.CMB.2.raw
  modified_base (329)..(329): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacgttggtcggacaagtcaagaactagttggactaacttactttaaatggtatcagcaaggtaagtcgaggacaaccgaccccgtacctctagactcgtacgtacactcctagtttnccagtaggtcggtactaccctataccgtaacggttacaggtacggtagtaaggtacgtacgttacgtaaacgggtaaaccttaaaggttaacccttttaccccgtacccgtaaaccgttaccggtaaccggttaacgggggttccctaaaccggtccgtaacccggtttaacggtaaagtttagttttaccgggtaaccgttaacctttaacggtttaccttaacgtaacccgtaaacgttaaaccgttacccgttttaccccgttacccccgttaaccccccggggttagttaccccgggaaccggtaaaacggaccggtaaacggttaaacgaaaccgtaacggtaacggtaacgtaaacgtcgggtaacgtcgtaaccgtccgactaacgttcggttacttacctactccttaccggttcctaccg

SEQ ID NO: 365232 - DNA, 684 bp, Homo sapiens
  misc_feature: GZ8MTXP02G82JB.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtccaccatcacttggtcgggactaagtcaagaactagttggactaacgttactttaaattggtatcagcaagagtcgaggaccaacgccccgaacctctagactaccgtacgtacactccctactttgaccataggtacggactacccccgagtaccgtaaagggttccaggttcgacgtaggttacgtaactcgtacggaaactagttaacctttttacccccgactaacctagtaccggtacggggttacctaacgacgtacccgtagtaaacgttagtttacgacgttaactttacctaagttaccggtactaaacgtaacgttacgtttacccccgttaccgtacccccggtacggttaccggaccgtaaacggggaaccgtaacgggtaagtaaacgtacgtaaacgacgtaacggtaggtacgtactacggaacctacgtacttcgttacgtacctttcactttaccccg

SEQ ID NO: 365233 - DNA, 730 bp, Homo sapiens
  misc_feature: GZ8MTXP02JDMLN.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacacgggtcaccatcacttggtcgggacaagtcaagaactgttacggactaacttactttaaattggtactcgaagtacgaaggtaaacgtcgaaggggaccaaccggcccccgaaacctttccgagtaacttaccgtaaccggtacctaacttcccgtaactttcggacctacgacgggttacggtacctacccgtaagtaccccggtaaaggttccgagggtacggtacgaacggttaagtaccgtacgtaacggggtaaacctacggtttaaccttttaccccgaccaaccctaacgtccggtaacgggggttacctaaccggtacgtaccgttaagtaaacgtttgtttacggacgttaacctttacgttagtttacgtaacctagtaacgtacgtttacccgtccgtacccccggtacgttccggaacgtaacgggaccgtaagggtacgtaaacgtacgaacgtacggacgttagacggtcgtacgctaacgtaactctacgttactctacgttcctacctaccg

SEQ ID NO: 365234 - DNA, 658 bp, Homo sapiens
  misc_feature: GZ8MTXP02F57XO.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacaggtcaccatcacttggtcgggacaagtcaagaactagttggactaaacttactttaaattggtacttcagacaagaagtcgagggacaacgccccgaactctgatcgtacgtacatcctactttgacacgtagtcggactacccataccgtaaggtcagtcgactagtagtatcgtaggaaactacgttaccttttaacccactaacctataccggtacgggtactaacgacgtccgtagaacgttagtttacgtcgtaacttacttaagttctaaccaaacgtacgtacgtttacccttacccgtacccccggtagttcccggtaaccgtaaacggacccgtaaaggtaacgtaaagtaaccgaacgtaaacggaacgttacggtacggtacgtacgaccgaaccctaagttaccgttacgttcctaccgtttaaccttccgttaccccgttaaccg

SEQ ID NO: 365235 - DNA, 668 bp, Homo sapiens
  misc_feature: GZ8MTXP02JMW7O.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacgttgtcggacaagtcagaactattggacaacttctttaaatggtatcagcagaagtcgagggacaacgccccgaactccagactacgtacgtacactcctactttgacacgaggttaggactccctataccgtaaggttccaaggttcggacaggttagcgttacgtagggtaaactaggttaccttttaccccgcaaacccgtacgttacggtaaccggggtttaccaacgacgtacccgttagaacggttattttcggacttactttacttagttcgtaacaacgtacgttaccgttacccgtttacccggaccccggtacggtttaccggaccggtaaacgggacccgtaaagggggttacaaaacgttacgaacggtaccgtaaaccgttgggtacgacgttacggaccaacctggtacttcggttaacttcaccgttcccttccgaacc

SEQ ID NO: 365236 - DNA, 706 bp, Homo sapiens
  misc_feature: GZ8MTXP02IXLFP.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatcccaccctgtctgccgtctcgtcggagacgagggtccaccatcacgttggtcgggacaagtcaagaactagttggactaactactttaaattggtatcagcagaagtcgagggacaacgaccccgaacctcctgactcgtacgacactcctactttgactacgaggtggtactccaatacccgtaagttcaggtgacagtagagtcgtaggaaactacgttaacttttacccactaccaacgttccgaggggtacctaacgacgtaccgtaagtaacgttacgtttacgaccgttaactttaactttagttaccgtaacgtaaaacgtacgttaacgtttaccccgttacccgtacccccggtacggttaccgggacccgtaaacggggaaccccgtaaaggggtaacggtaaaacgtaaccggaaaacggtaccggtaaaccgtagggtacggttaccgacgtaccgaaacccgtaagttcccgttaggttacccttactaacccgtttacccttccccgttaaacccccg

SEQ ID NO: 365237 - DNA, 715 bp, Homo sapiens
  misc_feature: GZ8MTXP02H08N2.13.53.E09.1.454.CMB.2.raw
  modified_base (401)..(401): a, c, t, g, unknown or other
tcagtcacgtactacacgaccggtgctcgatttagagagagtgtgttgggtttgggggagtcagtctcagtcaggacacagcatggacatgagggtccccgctcagctccgtggggcctcctgctactctggctccgaggtgccagatgtgacatccagatgagccagtcctccatcccaccctgtctgcgttctcgtcggagacgagggtccaaccatctacgttggtcgggacaagtcaagtaactagttggactaacgttactttaaagtggtatcagacaggaagtcgaggacaacgccccgaactcctgactctaacggtacacttcctaacgtttgctaacgtggtaccggtactaccctatacccgtaaaggttcctaggtcggataggtaagnttcgagtaaaccgtattaacctttaccccactaccgtaagtcggtaacgggtacctaacgtacgaccgttagtaaacgttgttttaccggaacttacctttaattaacgttcgtaaaccaaacgttcggtaaaccctttcccgttacccccgtaccccgggtagttaccggaccggaaacgggttaaacccgaggttaaaacgggaactaaacgtacggtaaaacccgtcgtagggtaacggtcctaacgggcccctaaagtcgtccgtttaaacgttcccttaactaaccctttccggtttaacccccgtacg

SEQ ID NO: 365238 - DNA, 669 bp, Homo sapiens
  misc_feature: GZ8MTXP02FVZ4U.13.53.E09.1.454.CMB.2.raw
  modified_base (234)..(234): a, c, t, g, unknown or other
  modified_base (386)..(386): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcagaacnttggcaactcttaaatgtatcagcagagtcaggcaacgccccgaactcctagactcgtacgtacatccactttgcacgagtcgggactcccaagtccctaaaggttcaaggtcggacaagtagatcgaggaaacctagtacttttaaccccncgtaccctacgtcgacggggttactacgacgtaccgtagtaacgttattttacgccgttaacttaccttagtttacgtaactaaacgtacgttaaccgtttacccttacccgttacccccgggtacgttaccgggaccgtaaacggggaaccgtaacgggtaacgggtaaaactaccggtaaaacggacggtaaacgtaacggttacgggccgttacggaccgtaaccgtaacgttcttacggtttaccttccgttaacgttcccgttacccccgttaacccg

SEQ ID NO: 365239 - DNA, 749 bp, Homo sapiens
  misc_feature: GZ8MTXP02IM5QA.13.53.E09.1.454.CMB.2.raw
  modified_base (365)..(365): a, c, t, g, unknown or other
tcagtcacgtactacacgaccggtgctcgatttagagagagtgtgttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacaggtcaccatcacttgtcgggcaagtcaagaacattggcaactctttaaattaggtatcagcagaaagtcagggacgaacgacccccggaaaccttccctacggtactactaccggttaacactacctactttcgcgaacagtgggactcccactacgtaacggttntaaggtcgtcaaggtagagttactaggtaaacacggttaacttttacccttccaaaccctagaccctagggggttcccgtaacgacgaacccgttggtaaaacgtagttttacggtaccgtaaacgtttacctttaatttacgtttacgaaaaccgttaagaaaccgggttttaaccttccccgtttaacccccggggttaccccggttacccgggttaccggaaaacggggtaaacccgttaaacgggggaaaaccggtaagttaaaacccggtaaacgaaccgtaacgggttaaaaccggttggttaccggcccggttaaacgaccccgtaaacgcctttacgtaccgtttccgttaacctttcccggttaccccttacccg

SEQ ID NO: 365240 - DNA, 667 bp, Homo sapiens
  misc_feature: GZ8MTXP02F67O7.13.53.E09.1.454.CMB.2.raw
  modified_base (379)..(379): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaacttactttaaagttggtatcagcaagaagtcgaggccaacgcccccgaacctcctgactcgtacggtacactccctactttcgactacgtaggtcgggactacccctatacccgtaacggttcaggtcggactagtagngtcgtaggaactagttacctttacccgactacctacgtacgtaacggggtacctacgacgtacccgtagtaagttagttttagtacgtacttacttagttacgtaactaacgtacgttacgtttacccgttacccgtacccccgggtacggttaccggaccggtaaacgggacccgtaaaggggtacgtaaaacgtacgtaaacggacgtaaccgtaggtacgtacgtacggtacccaccgtaacgtcttacggttaccttacgtaccttcccgttacccgttacccg

SEQ ID NO: 365241 - DNA, 654 bp, Homo sapiens
  misc_feature: GZ8MTXP02GL35W.13.53.E09.1.454.CMB.2.raw
  modified_base (235)..(235): a, c, t, g, unknown or other
  modified_base (459)..(459): a, c, t, g, unknown or other
tcagtcacgtactacacgaccggtgctcgatttagagagagtgtgttgggtttgggggaggtcagtctcagtcaggacacagcatggacatgagggtccccgctcagctcctgggctcctgctactctggctccgaggtgccagatgtgacatccagatgagccagtctccatcccaccctgtctgccgtctctcggagacaggtcaccatcacgttgtcggacaagtcagaacnttggacaacttactttaaatggtatcaagcagaagtcagggaccaacgaccccgaaccgttcaggtactcgtacggacatcctaactttgacacgtaggttggacctcccaagtcccgaaacgggtttccaggttgggaccttaagaggacttcgaacgggtaaactacgttactttttaccccacggacaatcgaggtactacaagcctagagttactttcgntaactatacgttgtacaacgtagtacgttaccttccgaaccccgtaggtcccgtaacgtaaccggacgtaaacgggtacgaaacgttacgtaacgaccggtaaagttcgggcggttacggtacccacggtaaccgtaacgttacggttcccgtttaaacgttccgttacccggtttaccgtacccccgtttcccg

SEQ ID NO: 365242 - DNA, 768 bp, Homo sapiens
  misc_feature: GZ8MTXP02GBTNL.13.53.E09.1.454.CMB.2.raw
  modified_base (296)..(296): a, c, t, g, unknown or other
  modified_base (300)..(300): a, c, t, g, unknown or other
  modified_base (320)..(320): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacgacgggtcaccatcacgttggcggacaagtcaagaactagtcggacaacttactttaagttgtatcagcagagtcgaggacacgccccactcctnactntacgtactactcctactttncagtggtggactacccataccgtaaaggttcaggttacgacgtaagtacgtacgtacgtaacgggtaactaaccgttaccttttaaccccacaacccgtttaccggtaggtaaaccggggttacccaaacggtaccgtaaccgttaggaaaaccgtttttgttttaaccccgggtattaaaaccgttttaacctttagtttacccgggtttaaacccaaaaaggttaccgggtttaaacccctttttaacccccggttcccccggttaaacccccgggtaccggggtttaccgaaaaccccggggaaacggggtaccccgtaaaaggggtaaacggttaaaaccctacggggaaaaccgtaccggtaaacgttagggtaccccggggtactaccggtaacctaccgtaacgtttcgtctttacctactttaccgttaccccacgtacc

SEQ ID NO: 365243 - DNA, 701 bp, Homo sapiens
  misc_feature: GZ8MTXP02IYV78.13.53.E09.1.454.CMB.2.raw
  modified_base (301)..(301): a, c, t, g, unknown or other
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacagggtccaccatccacgtttggcggacaagtcagaacagttggactaacttactttaaattggtaatcagcagaagtcgaggacaacgaccccgactcngactctacgtacactcctactttcgacacgaggtacgggactacccctagtaccgtaagttccgaaggttcggggactaacggttagcgtttacggtaacggtaaacctaacgttaccctttttaaccccgcctaaaccctacgttacggtaacgggggttacctaacgtacggtacctaggaaacgtttagtttacgtaccgttaacgttacttaagttacgtaacgtaaacgttacgtacccgtttacccgtaccccgtacccccgggtacgttacccggacgaaaccgggtacgaaacggtagtaaactaacgaacggtacgtaaccgtaggtacggtacgtacgtaccaccgtaacttccggttctttacctcttaccttccgtacccccgttacg

SEQ ID NO: 365244 - DNA, 781 bp, Homo sapiens
  misc_feature: GZ8MTXP02GJ1ST.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacagggtccaccatcctacgttggtcgggactaagtcaagaactagttcggactacttactttaaattggtatcagacagaagtcgaggacaaccgaccccgaacctcctagactaccgtacggtacacgttacctacgtttgaccacgtaggtacgggactaccccgtagttaacccgtaacgggttaccgtaaggtacggaccgtaaaggttaagttaccgtacggttaacggggtaaaacttaccgtttaaacccgttttttaaccccgaccttaaacccgttaacgttaaccgggtaaccgggggtttaccttaaaccggaacgttacccgtaaaggttaaaacggttttacgtttttacggtaacccgttaaccttttaaacgttagttaccgggttaactaaacgttaacggttaaccgtttaccccgtttaccccggttacccccgggttacggtcccgggtaaccgaaaccgggtaaccgtaaacgggtacgtaaaacgttacgaacggtacgaacgtggtcggacgtcgactactaacgttcttacgtccttactctacccgttcctaccg

SEQ ID NO: 365245 - DNA, 746 bp, Homo sapiens
  misc_feature: GZ8MTXP02FI4ZS.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgccgtctcgtcggagacgacgggtcaccattcacgttggtcgggactaaggtcaagaactagttcggactaaacttacttttaaagttgtaatcagcaagaagtcgacggacaaccgtaccccgaacctccgtagtactaccgtacgtaccactccgtaactttcgacacgtacggtcggaactacctactaccgtaaacggtttcgaaggtcggactaggtaagtctacgacggtaactacgttaccttttaacccacctacccgtagtccggtaacggggttacctaaccgtagacccgttagtaacgtttacgtttacgtaccgtttaaacttacggttaactttaacgtaacccgtaaacgttaacgttaacccgttttacccccggttaaccccgtacccccccgggtaaggtttaccccggaccggtaaaccggggtaaaccgttaacgggggacgtaaaacgttaaccgaaacggtaccgaaaggttccggtaggtccgacgtacctaacctaacgtccgttcgttacctacgtaccttcccgtttaccctaacc

SEQ ID NO: 365246 - DNA, 761 bp, Homo sapiens
  misc_feature: GZ8MTXP02JEBKS.13.53.E09.1.454.CMB.2.raw
  modified_base (241)..(241): a, c, t, g, unknown or other
  modified_base (709)..(709): a, c, t, g, unknown or other
  modified_base (759)..(759): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccacctgtctgcgtctctcggagacacgggtcaaccactcgtacgttcggacggactaacgtacgaanaacttagtcgtaaccttaactttaaacgttttaaggttacggttacacgtacgacgtaagtaaccgtacggacggaaccgaaccccggtacccccgtaaccctttaccggacgtaacgttaacccggttaaccgtaacctacccgttaccgtttaacggttcgaacccgtaacggttaacggggtacggaacccttaacccggtaacgttaaacccgggttaaccggtttacggtacggtacggaacccgttaaaggtaacgttcgtaccgggtaaacgtaaaccggtttacctttaacccgtttaccgaacctactaaaccgggtcgggttacggtaaaccttacgcgttaaccgtaaggttactttagttaaccgtcgtaaacttcgtaagtttcgaaactagttacgtaccttaccgtcccgtaccggcgttacgacggtaacgaacgaggtacaagcgagtacncgtaggactgaccgacgtacaacgtctacggtactcgtctcccgttaacncg

SEQ ID NO: 365247 - DNA, 699 bp, Homo sapiens
  misc_feature: GZ8MTXP02GNQ1Y.13.53.E09.1.454.CMB.2.raw
  modified_base (200)..(200): a, c, t, g, unknown or other
  modified_base (253)..(253): a, c, t, g, unknown or other
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcgganacgagggtcaccatcacgttggtcgggcaagtcaagaacattggactaacttntttaaatggtatcaagcaaggtaagtcgagggaccacgacccccgaactcctaggtactacgtacggtaacacttccctacgtttgacctacgtagggtccggtaactcccgattaccccgtaaggtttcgaggttacggacgtagtaacgtcgttacgtaacgggtaaacctagttaacccgtttttacccccaccaaactacgttaccgggtaacggggttacctaacggtaccgtaccgtaggtaacgttagttttaccgacgttacctttaacgttattacggtacctaaacttagttaccgtttacccgttacccgtacccccgggtacggttacccggacggtaaaccgggaaccgtaagggtaacgtaaagtacggaacgtaccgtaacgtggtacggcacggcctacgtaatcgttacgtcttacactccgtacctcc

SEQ ID NO: 365248 - DNA, 640 bp, Homo sapiens
  misc_feature: GZ8MTXP02FUGDU.13.53.E09.1.454.CMB.2.raw
  modified_base (188)..(188): a, c, t, g, unknown or other
  modified_base (376)..(376): a, c, t, g, unknown or other
tcagtcacgtactacacgaccggtgctcgatttagagagagtgtgttggggtttgggggcaggagtcagtctcagtcaggacacagcatggacatgagggtccccgctcagctcctggggctcctgctactctggctccgaggtgccagatgtgacatccagatgagccagtctccatccacctgtcngcgtctcacggagacagggtcaccatcacgttggtcgggactaagtcaagaactagttcggactaacttactttaaattggtaatcagcaagagcgagggacaacgaccccactctgatccgtaacgtacactcctacttgacacgagtacggactacccccgatacgtaagtcagtaggactaggtnagtcgagtacaagtactttacccacacgtatacgagggtctacgatacctagaattgttacgacgttacttacgtattactacgtaaccgtagttaccgtttaacccgttcccgtaccccggttacgggttaccgaccggttaaaccgggaacccgtaaaggtaacggttaaaacgaacggaacgtaacggaaacgttcgggtacgaccgttacgtaacgaaccctttaacgtccgttacgttccttaaccgttcgtttacccc

SEQ ID NO: 365249 - DNA, 640 bp, Homo sapiens
  misc_feature: GZ8MTXP02FGUIV.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaaccatcactttgtcgggctaagtcaagaactattggactaacttactttaaattggtaatcagcagaagtcagggcaagcccccgaactcctgatctaacgtcatccatttgacacagtcggactccccatcaaggttcaggtggactagtagactcgtaggaaactagtacttttaccctacacctatacgtagggtctaacgacgaccgtagtaaacgtatttacgaccgttaactttacgttaattagtacctaaagtacgtacgttaccccttaccggtaccccccggtacggttccgaaccgtaaccggggaaccgtaaaacgggtaacggtaaaacgtacgaaacggtaacgtaacgtacggtacggacgttacgaaccgtaaccctaaacttaccgtcgtttacctaccgtaactttcccccg

SEQ ID NO: 365250 - DNA, 752 bp, Homo sapiens
  misc_feature: GZ8MTXP02JHMXM.13.53.E09.1.454.CMB.2.raw
  modified_base (198)..(198): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcgganacgagggtcaccatcacgttggcggacaagtcaagaactgttggactaacttactttaaagttggtatcagacaaggaagtcgaggaccaaccggacccccgtaactccgtagtacgttaccgtaacggtacctacgtcctactttcgacaacgtagggtacggacctaccccgtatacccgtaaacgtttccgaggttacggacgtaagttaacgtcgttacgtaacgggaaacttaaccgttaccttttacccctacgaccctacgtacggtaaccggggttacaaccgtacgtacccgtaaaggttaacgtttagttttaccgacgtttaaacctttaagttacgttaacgttaacgtaaaaccgtggtttaacccgttttaccccgttaaccccggttacccccgggtacgggttacccggaaccgggtaaacgggtaccggtaaagggttaacgaaaacgtaccgaaaggtacccggtaaagtcgggtacggtactacggtaacccactaactcggttaacgttcctactaccttcccgtacctaaccg

SEQ ID NO: 365251 - DNA, 786 bp, Homo sapiens
  misc_feature: GZ8MTXP02IVCGN.13.53.E09.1.454.CMB.2.raw
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctctcggagacgaggtccaccatccacgtttggtcgggacaagtcaagaacattggactaaacttctttaaagttggtatcgagcaagaagtcgaggacaacgccccgaactcctagactcgtacgtacatcctactttcgacactacggtacggtacctcccgagttaccgtaacggttccgaagggttcggacgttaaacggttacgacgtttaccgtaaaggggtaaacctaacggtttaacccttttacccctactaaacccgtagttacccgggtaacgggttacctaacgtacggtacccgttaaaggttaaacgttttacgttttacggaacccgtttaacttttaccgtttaaagtttaccggttaacgtaaaccgttaaacgtttaccccgttttaaccccgtttacccccgacccccggggtttaacgttacccgggaaacccgggtaaacggggtaaccgtaaacgggttaacgaaaaccgttaaccgaaaacggaaccggttaaacgtcgggtacgtaccgtacggtaacccaaccgttaactaccgtttcgttacgttacctacgttccccgtttacccgacc

SEQ ID NO: 365252 - DNA, 754 bp, Homo sapiens
  misc_feature: GZ8MTXP02IKSOY.13.53.E09.1.454.CMB.2.raw
  modified_base (408)..(408): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgccgttctctcggagacagggtcaccatctacttggtcggacaagtcgaagaactagttggactaacttactttaaagttggtatacgagacaagtaagtcgaggggaccaaccggacccccgtaaacctccgtagactaccgtacggtactacttcctactttcgactacgtaggtcggtactaccccgtataccgtaggtaccgaggtggacgtaaggttangttacgtaacgggaaacctacggtttaaccttttaccccgaaccctaccgaacgttaccggtaacggggtaccttaaccgaacggttacccgttaaggtaaacggttttaacgtttacggtaaaccgttaacctttaacgttaaacgttttaccggtaaccgaaaacggtttacgtttaaaccctttacccccggtttacccccgtacccccggggttaccgtttaccggaacccggaaacgggtaaccgtaagggaacggtaaaactcggaaaagtccgtaaacgtcggttacgacgttaccactaactcgttactcgttctacctaccgtttccctacccgtac

SEQ ID NO: 365253 - DNA, 560 bp, Homo sapiens
  misc_feature: GZ8MTXP02I0DCR.13.53.E09.1.454.CMB.2.raw
  modified_base (365)..(365): a, c, t, g, unknown or other
  modified_base (370)..(371): a, c, t, g, unknown or other
  modified_base (373)..(373): a, c, t, g, unknown or other
  modified_base (380)..(380): a, c, t, g, unknown or other
  modified_base (390)..(390): a, c, t, g, unknown or other
  modified_base (424)..(424): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtcctcatccaccctgtctgcgtctcgtcggacgacgaggtccacatcgacgtttggtccgggataagtccaagtaactattcggacctaacttacttttaaagttggtatcaagcaagaagtcgaaggcaacgcccccgaactctgactctacggacactaccactttgctacgagtggactccgataccgtagtcagngcagnntnaggaacngttcttaccncactagtcgtaggtctacgcgtactagaacgttnttcgctattctagtactactacgtacgttaccttaccgttacccgacccgtagtacggacgtaacggacgtaggtagtaatacgagtacgtacgtgtacgtcgtacgctactgtcttctactctactccttacctc

SEQ ID NO: 365254 - DNA, 730 bp, Homo sapiens
  misc_feature: GZ8MTXP02HIZKR.13.53.E09.1.454.CMB.2.raw
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcaggcaagccccgaaactccagatacgtacggtacactcctactttgacacgaggtcggactcccccatacgtaaggttcaaggttcggactaggtagtacttaccgagggtaaacctacggttaaactttttacccccactaaccctaacgttaccggaacgggggttaccttaacgacggtacccgttaaggtaaaggtttatttttacgggaccgtttaaactttaacctttaatttacggttaacccaaaataacgggttaaccgttttaacccctttccccggttaccccccgggttaacggtttccggaacccggttaaacggggtaaacccgaaaaggggtaaacgtaaaacgttacgaaaacgggaccgtaaaaccggttggttaccggggtaccgtacgtaaccgtaaccgtaacgtttcccgtacgtttaccctttacgttaccgttcccg

SEQ ID NO: 365255 - DNA, 708 bp, Homo sapiens
  misc_feature: GZ8MTXP02JXWHY.13.53.E09.1.454.CMB.2.raw
  modified_base (510)..(510): a, c, t, g, unknown or other
tcagtcacgtactacacgaccggtgctcgatttagagagagtgtgttgggtttgggggagtcagtctcagtcaggacacagcatggacatgagggttcccgctcagctccgtggggctcctgctactctggctccgaggtgccagatgtgacatccagatgagccagtcctccatcccaccctgtctgcgtctcgtcgggacgacgacggtcacctatctacgttggcggacaagtcaagaactagttcggacctaaactttactttaaagtcggtatcgaagcaaggtacgtcgacggggaccaaccgaccccccgtaaactccgtagtaacctttaccgtaacggtaactaccttacccgttaacgtttcaaccgtaaggtacgggtacggtaccctaccctaagttacccccggtaaggtttccgaggttccggagtaagtacgtacgtccggtaagtaaactacgttacctttacccgacaccgtaagtcggtaaggtcctaacgngtaccgtagtaaagttcttacggacttcttaacgttagtcgtaaactacggtaacgttaccgtttacccgtacccggtaccggtacggttaaccggaccggaacgggtaaccgaagttacggaaactacgacggacgttacggcggtcgacgcgtaactcgtaacgtcgttactacttaccgccgttacctccgtacg

SEQ ID NO: 365256 - DNA, 711 bp, Homo sapiens
  misc_feature: GZ8MTXP02HJFAJ.13.53.E09.1.454.CMB.2.raw
  modified_base (280)..(280): a, c, t, g, unknown or other
  modified_base (414)..(414): a, c, t, g, unknown or other
tcagtcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgacgccagtcctccatcccacctgtctgcgtctcgtcggagacgacgggtccacctatctacgttggcggacctaagtcaagaactagttggacctaaacttctttaaagtggttancgaagcaagagtcgaggtccaaccgtcccctaactcgagtactaccgtaacgtacacttccctagttcgacctaacggtaggtcggtacctaccccgtagtaacgtacgggttccaggttcgacgtaggtactntacggtacgtaacttacgttacctttacccactaacgtacgtacgtacgggtactacgtacgtacgtaagtaacgtttacgttacggacgtttaacttactttaacggtacgtttaacctaaacgtacggtttaacccgtttaccccgttaccccgggtaccccggttaaccgggttaccggaaccgggtaaccggtaaaacggtaaccgggtaaacgttaaacgaacggtaaccgtaacgtacgtacggcgtacgtacgaacctacgtactcgtacttacctctttaccttccccg

SEQ ID NO: 365257 - DNA, 674 bp, Homo sapiens
  misc_feature: GZ8MTXP02JN6H6.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacagggtccacctatctacgtttggccgggactaagtcaagtaactagttggactaactttactttaaagttggtatcgaagcaaggtacgtcgacgggacaacgacccccgaacctctgtactcgtaacgtacactcctactttgactagaggtacggactaccagtaccgtacggttcaggttcggactaggtatacgtacgtacggtaaacttacgttaccttttacccactaccgtagtcggtaaacgggttcctaaggacgtacgttaagtaacgttagttttaccgggtaacgttactttaacgttacgtttacgtaaacctaacgttacgtttaaccgtttacccccgttacccggtaccccgggtacgttaccgggacgtaacgggaacgtaaggtagaaaacgtcgaacgtacgacggtgacgttcgacgacaacctgtccttatcttactcctaccgttcaccg

SEQ ID NO: 365258 - DNA, 559 bp, Homo sapiens
  misc_feature: GZ8MTXP02J0617.13.53.E09.1.454.CMB.2.raw
  modified_base (192)..(192): a, c, t, g, unknown or other
  modified_base (365)..(365): a, c, t, g, unknown or other
  modified_base (421)..(421): a, c, t, g, unknown or other
  modified_base (558)..(558): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgaagccagtctccatcccaccctgtctgcgtcnctcggagacagggtcaccatcacgttgtcggcaagtcagaacattggacaactcttaaatggtatcagcagagtcaggcaagccccgaactcctgatcgtaacggtacaacgtcctactttgcacgaggtcgggactccccgatccgtaaaggttcaggttcggacaggttanatcgtaggaacagtactttacccacaccatcgagggttccacgacgcctgaacgtntttgactacttactagttgacaacagtacgttacctccgtccccgacgttccggaccgaacggaccgtaaggtagaaactacgaacgacgaacgtagtcggactcggacaaccgtctctacgtctctactccgtccnc

SEQ ID NO: 365259 - DNA, 763 bp, Homo sapiens
  misc_feature: GZ8MTXP02GROWN.13.53.E09.1.454.CMB.2.raw
tcagtcacgtactacacgaccggtgctcgatttagagagagtgtgttgggtttgggggcaggagtcagtctcagtcaggacacagcatggacatgagggtcccccgctcagctcctggggctcctgctactctggctccgaggtcgccagatgtgacatccagatgagccagtctccatcccacctgtctgcgtctcgtcggagacgaggtccaccatcacgttggtcggacaagtcaagaactagtcggactaacttactttaagttgtatcgaagtacgaagtaacgtcggaacgggaccaacccggacccccgtaaccgttccgtacgtacgttacccgttaaccggtaacctacctttcccgttacgtttacgaccgtaacgtaggtacggtacctaccccctacgtaccgtaaggttacgtacggtacgtacgtaggtagtaacgtacggtaaacgtaaccgtaagtttacctttaacccgactacgtacgttacgtaacggggtctaccgtacgtaccgttagtaacgtttacgtacgtaccgttaaatttaccgttattaccgtaataaccggttacgttaaccccgtttaccccgttacccggtaccccgggttacgtaccggaacccgtaacggggtacgtaaacgggttacgtaaaacgtaccgggaaacgtacggtaaacgtttcgggaccgacgttacgaacccttaaacgtcctttacgtaccggtttccttacttaccgtttcccccgg

SEQ ID NO: 365260 - DNA, 636 bp, Homo sapiens
  misc_feature: GZ8MTXP02I7PLU.13.53.E09.1.454.CMB.2.raw
  modified_base (198)..(198): a, c, t, g, unknown or other
  modified_base (289)..(289): a, c, t, g, unknown or other
  modified_base (450)..(450): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggganacagggtcaccatcacttgtcgggcaagtcaagaacattggcaactactttaaattgtatcagcagaatcgaggcaagcccccgaactccngatactacggtacatccactttcgacacagtggggatccccatccgaacgttcagtggcagtagatctaggaaacagtacttttacccacacatcgaagggtctaacgacgtctagaaggtatttttgaccgtaattaacttaattaggttactaaaacgngtaacgtttaccttccccgtaccccgtaacggtttccggaaccgtaacggggaaccctaaaggggtaacgtaaaagttaccgaaaacggacggtaaacgtaacggttacggtcgttaaccgcgtaccctaaatacccgtttacggtacctttaccctatttaccccggtttaccccgtaacccccg

SEQ ID NO: 365261 - DNA, 795 bp, Homo sapiens
  misc_feature: GZ8MTXP02FZGGP.13.53.E09.1.454.CMB.2.raw
tcagtcacgtactacacgaccggtgctcgatttagagagagtgtgttggggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacgagggtccaccatcacgttggcgggacaagtcaagaactagttcggactaacttactttaaattggtatacagacagagtcgaggacaacgaccccgaactcctagtactacgtacgtactactacctactttcgactacgtaggtacgggtacctcccgtaactaccgtaacggttaccgaggtacgggactaaaggttaagtagttaccgtaacggtaaaacgtaaccgttacctttttaacccccactaaacccgtacgttaccggtaacgggggttacctaacgtacgtaacccgttagtaaacgtttagtttacgtacgttaacgtttacttaacgttcgtaaacgtaacgttagttaacccgtttacccctttaccccggtacccccggttaccggttaccgggtaacccggtaaacgggtaacgggtaaacggttaaaacggtaaaacgttaacgaaaaccggttaacggtaaacccggttaggttaccggtacgttaaccggaacccgttaaccgtaaccgtttaccgttttaaccggtccctttaccgttaacccgtttcccccggtaacccctttacccccgg

SEQ ID NO: 365262 - DNA, 754 bp, Homo sapiens
  misc_feature: GZ8MTXP02IQ37F.13.53.E09.1.454.CMB.2.raw
  modified_base (410)..(410): a, c, t, g, unknown or other
tcagtcacgtactacacgaccggtgctcgatttagagagagtgtgttggggtttgggggagtcagtctcagtcaggacacagcatggacatgacgggtccccgctcagctccgtggggctcctgctactctggctccgaggtgccagatgtgacatccagatgacgccagtcctccactccaccctgtctgcgttctctcggagacgacggtacaccatctacgttcggtcgggacaagtcagaactgttacggactaacttactttaaattcggtatcgagacaagaacgtcgaacgggacaaccgacccccgtaactccgtagtactaccgtaacgtacactcctattcgacaacgtgggtacggactaccgactaccgtaacggtcaggtcggtataacggttaagngttacgtaacgtaaacacgtttaaccctttacccgactaaccgtacgtacggtacgggtacctaacgtacggtacccgtagttaaacgtttagttttaccgaaccgttactttaacgtatttaacggtaaacctaacgttaacggttacccttttacccccgttaccccggttaacccccggtacggtttacccgggaaacccgggtaaacgggtaaacccggtaaaggttaacggaaaacgtacgtaaaaccggtaccggtaaacggtacggttacgcccgttaacgaacctacctaacgtttacgtactttctaccctttaccttacccggtttccaacccg

SEQ ID NO: 365263 - DNA, 719 bp, Homo sapiens
  misc_feature: GZ8MTXP02FTT9S.13.53.E09.1.454.CMB.2.raw
tcagtcacgtactacacgaccggtgctcgatttagagagagtgtgttggggtttggggggagtcagtctcagtcaggacacagcatggacatgagggtccccgctcagctcctggggctcctgctactctggctccgaggtgccagatgtgacatccagatgagccagtctccatccacctgtctgcgtctctcggagacagggtcaccatcacttgtcgggacaagcagaacattggactaactactttaaattaggtatcaagcagaagtacgaagggacaaacgccccgaaaccctcgtagaactacgtaaccggttaacataccctaactttagacctaacgtaggttacggggactaccccgaagttaccccgtaaaggtttaccaaggttagggacctaaaggttaagggtacttacgttacgggaaaactacgggtttaaacctttttaacccaccaaaccctaaacgtacggtaacgggggttactaacgacgaccgttagaaacgtagttttaacgacgtaaactttaacttaaagttacgtactaaaactacgtaacgtttaaccccttacgttaccccccggtacgtacggtaccgtaaacggaacgtaaacgggtagaaacgtaaaacgaacgtaacgaaacgtaacggtacgtacgtacgaccgaccaactacgtacgtacttacgtacgttactacccgttaccc

SEQ ID NO: 365264 - DNA, 647 bp, Homo sapiens
  misc_feature: GZ8MTXP02FKN53.13.53.E09.1.454.CMB.2.raw
  modified_base (639)..(639): a, c, t, g, unknown or other
tcagtcacgtactacacgaccggtgctcgatttagagagagtgtgttggggtttgggggcaggagtcagtctcagtcaggacacagcatggacatgacgggtccccgctcagctcctggggcctcctgctactctggctccgaggtgccagatgtgacatccagatgagccagtctccatcccacctgtctgcgtctcgtcggagacgagggtccaccatcacgttggtcgggacaagtcaagaactagttcggactaaacttactttaaagttcggtatacagacaagtaagtcgagggaccaaccgccccgtaacctcctagtactacgtacggtacactcctacttgacacgaggtacggactacccccgataccgtaaggttccaaggtgactaggtacgattacgtacggaacttaggttaacctttacccgacacgtactcggtaacgggtctaaacgctcgtaaggaatttcgttaacgtcttaacttactattgaccgtaaacacgttaccgttacccttacccgtaccccgggtacgttaccgggaaccgtaaacgggggacctaagggtacgaaaacgcgtaaacggcgtaaacgtgtacggactcgaactacgtactgttctactacncgttcccc

SEQ ID NO: 365265 - DNA, 658 bp, Homo sapiens
  misc_feature: GZ8MTXP02FGTGI.13.53.E09.1.454.CMB.2.raw
  modified_base (314)..(314): a, c, t, g, unknown or other
  modified_base (481)..(481): a, c, t, g, unknown or other
  modified_base (634)..(634): a, c, t, g, unknown or other
  modified_base (645)..(645): a, c, t, g, unknown or other
  modified_base (649)..(649): a, c, t, g, unknown or other
tcagtcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccacctgtctgcgtctcgacggagtacacggggtcaacccatccgtaacgttcggtcggggcaaaggtccaaggaaccagtttagggcaactactttaaattggtaatcaagcagaagtccagggccaagccccgtaaccncgtgactactaacggtcaacgtcctacgtttagcaacgacggtggggtaactccccgtattacccgaaaggtttcgaagtttcggacgtaagtcggtatccgtaggtaaactacgtacttttaccctacaaccgtactacgaacggggtctaaactgtacccgttanaacggtaagttttcgacgtaacttacgtagttacacggtaactacgtaacggtttacccgtaaccgttccccccggtagttacccggacgtaaccggaccggtaacgtacgggaaaactaacgacgaccgtaagacgtacggcttacgcaacncgttcacttcntacncgttacctc

SEQ ID NO: 365266 - DNA, 457 bp, Homo sapiens
  misc_feature: GZ8MTXP01D6UH0.38.46.E02.1.454.CMB.2.raw
  modified_base (346)..(346): a, c, t, g, unknown or other
  modified_base (377)..(377): a, c, t, g, unknown or other
  modified_base (436)..(436): a, c, t, g, unknown or other
  modified_base (445)..(445): a, c, t, g, unknown or other
  modified_base (448)..(448): a, c, t, g, unknown or other
  modified_base (450)..(457): a, c, t, g, unknown or other
tcagtcgatcacgtcacgaccggtgctcgatttagactcatctacagggaaaggggctggagtgggtctcatctattaacggtcctggttccaccacatacttcgcagactccgtgaggggccgcttcaccatctccagagacaattccaggaacacactggatctgtatttgaacagcctgagagccgaggacacggccatttattattgttagtaaacagtctgaggcctacaacagtggctgggactggtacttcgatctcgtggggccgtggcacccctggtcactgtctcctcacgccctccaccgaagggccccagtccggtccttccccccgtggcccncccctgctcccgaggacgccacccctcgagngcacagccgccctgggctgcctggtcaaggctacttcacgtgatcgactgagcgggcgnggcaggcanagngnnnnnnnn

SEQ ID NO: 365267 - DNA, 459 bp, Homo sapiens
  misc_feature: GZ8MTXP02ILGAQ.38.46.E02.1.454.CMB.2.raw
  modified_base (124)..(124): a, c, t, g, unknown or other
  modified_base (221)..(221): a, c, t, g, unknown or other
  modified_base (237)..(237): a, c, t, g, unknown or other
  modified_base (452)..(459): a, c, t, g, unknown or other
tcagtcgatcacgtcacgaccggtgctcgatttagactcatctacagggaaaggggctggagtgggtctcatctattaacggtcctggttccaccacatacttcgcagactccgtgaggggccncttcaccatctccagagacaattccaggaacacactggatctgtatttgaacagcctgagagccgaggacacggccattttattattgttgtaaacngtctgagcctacaacngtggctgggactggtacttcgatctcgtggggccgtggcaccctggtcactgtctcctcagcctccacaagggccccatccggtcttccccctggccgcccctgcctccgaggacgccaccccctccgagacgcacagccggcccgtgggctggccctgggtcaaagggtcctacttccacgtgatcgactgagcgggctggcaaggcgcaatgnnnnnnnn

SEQ ID NO: 365268 - DNA, 444 bp, Homo sapiens
  misc_feature: GZ8MTXP02H6QF7.38.46.E02.1.454.CMB.2.raw
  modified_base (327)..(327): a, c, t, g, unknown or other
  modified_base (434)..(434): a, c, t, g, unknown or other
  modified_base (437)..(437): a, c, t, g, unknown or other
  modified_base (440)..(444): a, c, t, g, unknown or other
tcagtcgatcacgtcacgaccggtgctcgatttagactcatctacagggaaaggggctggagtgggtctcatctattaacggtcctggttccaccacatacttcgcagactccgtgaggggccgcttcaccatctccagagacaattccaggaacacactggatctgtatttgaacagcctgagagccgaggacacggccatttatattgtgtaaacagtctgaggcctaacaacagtggctgggactggtacttcgatctctggggccgtggcaccctggtcactgtctcctcagcctccaccaagggccccatcggtctcccccnggcgccctgctccaggagcacccctccgagagcacagcggccctgggctgccctggtcaaaggcctaacttccacgtgaatcgactgagcggctgggcaaaggccgntanagnnnnn

SEQ ID NO: 365269 - DNA, 536 bp, Homo sapiens
  misc_feature: GZ8MTXP01E2VXG.2.1.A01.1.454.CMB.2.raw
  modified_base (342)..(342): a, c, t, g, unknown or other
tcagacgctcgacacacgaccggtgctcgatttagacgtctcatcagggggagttagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacatgttaataatgtggctgtatcagcagaaaccagggaaacgccccctaaactccctgatctctgatgcctcaatttggaaagtgggtccatcaaggttcacgcagtgatctggaacacngttcactctcaccatcagcagcctgcagcccgatcgacctttgctacttcttattactcggtacctaaactagttaactaattacgtttcgtcggttacgtacggttccgggagggagggaacggtaagggtaggagaacgttacgaaacggtacgttgttggactcgctaacctctcttctccttaacgtccc

SEQ ID NO: 365270 - DNA, 488 bp, Homo sapiens
  misc_feature: GZ8MTXP01EFZV3.2.1.A01.1.454.CMB.2.raw
  modified_base (336)..(336): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggcagtcaacatgtaatatggtgctggtatcagcagaaaccagggaagcccctaaactcctgatctctgatgcctcaatttggaaagtgggtccatcaaggttcaccggcagtgatctgggacncagttcactctcaccatcagcagcctgcagcccgatgacttgcatcttatactgcctaaacagttaataatagtttctacggtctagtttcggcggtagggaacgaaggttgaggatacgaaagacttgaggctgcaccattctgttctaac

SEQ ID NO: 365271 - DNA, 657 bp, Homo sapiens
  misc_feature: GZ8MTXP01D7P8R.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccggcagtcaacatgttaataattggtgctggtatcagcaagaaaccaagggaaacgcccctaaactcctgaatctctgactcgacctacaagttttagggaaaggttcgggggtacccagttacgaaaggttccaccccggcgaagtggatcgtagggacaacgagttaccactctaccaaccatcagcacggcctgacacgacccgatgtaccttgactattactttaacttacgtacgtacctaaacctaaggttaattaaattacggttttacgttaccgggttacttacggggttttacgggaccggggttaaagggggaacgggtaaaggggttagggaaaggttaaacgtaaccgggtaaaaagggttaaccggttgggttacggggttccacgggtaacccgtaaccctatttccgttcggtttaacccttttaacccgg

SEQ ID NO: 365272 - DNA, 631 bp, Homo sapiens
  misc_feature: GZ8MTXP01C9SDE.2.1.A01.1.454.CMB.2.raw
  modified_base (202)..(202): a, c, t, g, unknown or other
  modified_base (220)..(220): a, c, t, g, unknown or other
  modified_base (349)..(349): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccacctgtctgcatctgttggagacagagtcattancacttgccggcagtcaanatgttaatattggtggctggtatcagcagaaaccagggaaagcccctaaactcctgatctctgatcgcctaccaatttagggaaagtggggtacccatcaaggttcacccggcagtgatcgtagggacncagttcaactctacaccatcagcacgcctgcacgaccccgtatcgtacgtttcgactacttacttactttacttcgaccctaaaacctaaggttaatttaaacgttacgttttaccgtttaccgggttacgttacgggtttttaccgggggccgggttaaagggggaaccgggtaaaggggttagggaaggttaagtaaaccggtaaaaagggttaaaccgtttggttacgggtccgttacggccgtaaccctagttacccgttggtttccgttttaacccg

SEQ ID NO: 365273 - DNA, 524 bp, Homo sapiens
  misc_feature: GZ8MTXP01CECN1.2.1.A01.1.454.CMB.2.raw
  modified_base (346)..(346): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggcagtcaacatgttaatatggttggcctggtatcagcagaaaccagggaaagcccctaaaactcctgatctctgatgcctcaatttggaaagtgggtccatcaaggttcacccggcagtggatcgtagggacncgagttcactctcaccatcagcagcctgcagcccatcgactttgctatcttattactgacctaaacagttataaattagtttctcgggttctaggtttcgggcgggtaaggggaacggaagggttggaagagttacgaaaggacttggttcggaactggcacctattcctgttctttc

SEQ ID NO: 365274 - DNA, 771 bp, Homo sapiens
  misc_feature: GZ8MTXP01EB77W.2.1.A01.1.454.CMB.2.raw
  modified_base (190)..(190): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttgganacagagtcattatcacttgccgggcagtcaacatgttaatattggtgctggtatcagcaagaaaccagggaaacgacccctaaactcctgatctctgatcgcctacctaagttttagggaaaacggttcgggggtacccctaagttacgtaaacgggtttccgaacccccgggacgaaggttgggtaacgttccgttaagggggaacctaacgtagggttttaccaccttcctaccaaccctactacgaacggcctaacgggacccttcggacccgtaaacggccccccggtaagttaccggttaacctttttcggacccttaaagttttacccttttaaacgttttaacccgttacggtaaaccccgtaaaacttaaacggtttaaattaaaacgtttaaccggtttttccgtttaaccggggttcgttaaacggggtttttccggggaccgggggttaagggggaaacggtaaagggggttagggaaccggttaaagttaaccggaaaaggggttaaccgtttgggaggggtccttacgggaacctaacccgtattccggttcgttccgttttaacccg

SEQ ID NO: 365275 - DNA, 564 bp, Homo sapiens
  misc_feature: GZ8MTXP01D88JP.2.1.A01.1.454.CMB.2.raw
  modified_base (191)..(191): a, c, t, g, unknown or other
tcagacgctcgacacacgaccggtgctcgatttagacgtctcatcaggggggagtcagactcagtcaggacacagcatggacatgagggtccccgctcagctcctggggctcctgctgctctggctcccaggtgccaaatgtgacatccagatgacccagtctccttccaccctgtctgcatctgttgganacagagtcattatcacttggccgggcagtcaacatagttaataattggtggctggtatcagcaagaaaccagggaaacgcccctaaactcctgatctctgatcgcctacctaagtttgggaaaggtcgggggtacccaagtacgaaggttccacccgggctaggtggatcgtagggacaacgagttcactctcaccatcagcagcctgcagccccgatcgacttgctatcttattactgacctaaactagtaataattgtttactcggttctaagggtttcgggacgggtaaggggaacgtaagggttgggaacgaagtaacgaaaagggttacgttggttaggctagcaccgtattcgtaacgttcttaacc

SEQ ID NO: 365276 - DNA, 601 bp, Homo sapiens
  misc_feature: GZ8MTXP01AMII0.2.1.A01.1.454.CMB.2.raw
  modified_base (224)..(224): a, c, t, g, unknown or other
tcagacgctcgacacacgaccggtgctcgatttagacgtctcatcagggggagtcagactcagtcaggatacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacntgttaatattggtgctggtatcagcagaaacgagggaaacgcccctaaactcctagatctctgatgcctacctaatttgggaaacgtgggggtcccagtcgaaggttcacccggcaggtggatcgtagggactcagttcactctcacatcagcagctgcacgcccgatgtacttgctattctttatactacgacctaaactagttaaataacgttacgtttacgttaccgggttactacgggttttccgggacgggggtaaggggtaaccgggtaaggggttagggaaggttaaagtaccggtaaaagggttaaccgttgggttacgggcgttacggaacctaaccctacgttaccgttcggtttccgtttaacccg

SEQ ID NO: 365277 - DNA, 625 bp, Homo sapiens
  misc_feature: GZ8MTXP01AR1WJ.2.1.A01.1.454.CMB.2.raw
  modified_base (346)..(346): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggcagtcaacatgttaatattggtggctggtatcagcagaaaccagggaaacgcccctaaactcctgatctctgatgcctccaatttgggaaagtggggccatcaaggttcaccggcagtggatcgtagggacnagttcactctcaccatcagcagcctgcgacgaccgacgtcgtacttcgtctactacttacttacgttacgtaccgtaaaccgtaacgttaacttaaattaacgtttacgtttaccggttacgttacggtttacggggtaccggggtaacgggggaaacgggtaaacggggttaaggggtaacgggaaaggttaaccgaaaacgggttaaacggttaacgggttagggaacggttcgggtaaccgaacccgtaacgttaccgttcgttccgtttaacccg

SEQ ID NO: 365278 - DNA, 695 bp, Homo sapiens
  misc_feature: GZ8MTXP01BQ8TR.2.1.A01.1.454.CMB.2.raw
  modified_base (674)..(674): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcactgccgggcagtcaactatagttaatagttggttggcctggtatcagacaagaaaccgaagggaaacgaccccctaaactcctagatctctgactcgacccttaccgtaagtttacgggaaaacggttcgggggtacccagttaccgtaaacggtttccgaaccccgggtctaaggtcggaattccggtaacggggaacctaacgtacgtttaccaccttccctacctaacctatccacggaccaacggtcccgtgaccgacggtaccccgtagttacggtactttagaccttactttactttaacttaccgtacgtaaccctaaacgtaagttaactttaaacgtttacgtttacgttacggttacgttacgggtttccggggacggggtaacgggggtaaacggtaaggggttaggaagttacgtaacggaaaggttacgttggttcggtaacttacgcctaacgtnttacgttcgtttccgttaacc

SEQ ID NO: 365279 - DNA, 584 bp, Homo sapiens
  misc_feature: GZ8MTXP01DGSGR.2.1.A01.1.454.CMB.2.raw
  modified_base (222)..(222): a, c, t, g, unknown or other
tcagacgctcgacacacgaccggtgctcgatttagacgtctcatcaggggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccggcagtcaanatgttaatattggtgctggtatcagcagaaaccagggaaacgcccctaaactcctagatctctgatcgcctacctaagtttagggaaagtcgggggtacccagtacgaaggttcgacccggcagtggatcgtagggacaacgtagttcactctccacatcagcacgcctgcacgcccgtatcgtactttgactattcttaacttacgtcgtaacctaaactagttaattaattacgtttccgtacggtacgttagggtttccgggacgggtaaggggaacggtaagggttggaagagtaacgaaagggttaaccgttggttacggctacggccgtaactacgttacttcgttctttaacccg

SEQ ID NO: 365280 - DNA, 848 bp, Homo sapiens
  misc_feature: GZ8MTXP01EJZ2A.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgctatcttgttggagacagagtcattatcacttcgccggccagtcaacatgttaatattggtgctggtatcagcagaacaggaacgaccctaaactctgatctctgatcgcctaccgtaagtttagggaaaggttcgggggtaccctagtaccgtacgggtttaccgaaccccgggtacgtagggtacgggtaacgttccggtaacgggggtaaccctaaccgttacgggttttaccctaacgtttcccccttaccgaaaccccgtcttaaccccggacggttacccgtaaccgggccccgttaccgggacccgaaccgggtaccccccggttaaagttcggtttaaacctttttccgggacctttaaaccgtttttaccgtttaaaccttttaaaccgggttcccggtaaaaccccgtaaacctttaacggtttaaaattttaaaacgtttttaacgggttttttacccgttcccgggggttttaaccgggtttaacgggggttttacccgggggaacggggggtaaaaccggggggtaacggggttaaaacgggggtttacgggggaaacgggttaaagtaaaccggggttaaaaaacgggaacggtttggggttcggttaacgcggtaacccgtaaaccgtacttcgttccgggtttcctttaacccg

SEQ ID NO: 365281 - DNA, 658 bp, Homo sapiens
  misc_feature: GZ8MTXP01D5RYI.2.1.A01.1.454.CMB.2.raw
tcagacgctcgacacacgaccggtgctcgatttagacgtctcatcaggggggagtcagactcagtcaggatacagcatggacatgagggtccccgctcagctcctggggctcctgctgctctggctcccaggtgccaaatgtgacatccagatgacccagtctccttcaccctgtctgcatctgttggagacagagtcattatcacttgccggcagtcaacatagttaatattggttgctggtatcagcagaaaccaagggaacgcccctaaactcctgatctctgatcgacctacctaaagttttgggaaaaggttcgggggtaccccaagttaccgaaacgggtttccaccccgggcaaggttgggaattccgtaacggggaacctaacgtagtttccaaaccttctaccaaccataccagcacggcctgccacgcccgattcgtactttgactattctttaattacgtacgtaccctaaagtagttaattaaacgttcgttttaccgtacgggttcgttacgggttttccggggaccggggtaagggggaaaccggttaaagggttggggaaagttacgttaaaccggaaaagggttaaccgttgggttacgggcttacggaacctaccgtattcttaacggtttcctttaaccg

SEQ ID NO: 365282 - DNA, 631 bp, Homo sapiens
  misc_feature: GZ8MTXP01CJCE0.2.1.A01.1.454.CMB.2.raw
  modified_base (225)..(225): a, c, t, g, unknown or other
tcagacgctcgacacacgaccggtgctcgatttagacgtctcatcaggggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttcggccggccagtcaanattagttaattagttggttggctggtatcagacaagaaaccgaagggaaacgacccctaaactcctgactctctgactcgacctactaagtttagggaaacggtcggggtacccaagtacgtaacggttccgaccccggctaggtcggactccggtaacggggaacctaacgtagttaccaccttcctaccaacctatccagcacgcctgaccacgacccgtattcgtactttcgacttattctttaattacgtcgaacctaaactagttaattaacgttacgtttcgttacgggttcgtagggtttcgggacgggtagggaacggtaagggttgggaagacgtaaacggaaagggttacgttgggttcggtcgtcgaaccacgtattcgttcgttccgtttaacc

SEQ ID NO: 365283 - DNA, 811 bp, Homo sapiens
  misc_feature: GZ8MTXP01B77HX.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccggccagtcaactatagttaatagttggttggctggtatcagcaagaaaccgagggaaacgacccctaaactcctagatctctagactcgccttacctaagtttagggaaacggttcgggggtacccctaaagttaccgtaaacggggtttcccgaaacccccgggtacgtagggttagggtaacttccgggttaaacgggggaaccctaaccgtaacgggttttacccaaacccgttcccgttaacccaaccctaacgtaccgaacggtcccgaaacggtccccgttcggaacccaaccgggtacccccggttaagttacggttaaaccgtttttcgaccttaaacttttaccttttaaactttaacccggtacggttaaaccccgtaaataaacggtttaaacttaaaacgttttaccggttttaccgttacggggttaccgttacgggggttttaccggggaaccgggggtaaagggggtaaccggtaaagggggttacgggtaaagaacggttaaaccggtaaaaggggttaccggttgggttaggtcccgttacggaaccctaaccttacgttcgttaacgtttccctttaacccg

SEQ ID NO: 365284 - DNA, 703 bp, Homo sapiens
  misc_feature: GZ8MTXP01BMSKH.2.1.A01.1.454.CMB.2.raw
  modified_base (245)..(245): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggcagtcaacatgttaatattggtgctggtatnagcagaaaccagggaaacgcccctaaactcctgactctctgatcgacctaccgtaaagtttgggaaaaggtcgggggtaccccaagtaccgtaaacggggtttccgaacccccggggtactacgggttagggaacttccggttaacgggggaacctaaccgtaacggtttcccaaccttccttaccaaccctaatccaacggacctaacggcccgttaggcccgaacggtaccccgtaattcggtacctttgacctattacctttacttactacggtaacctaaacctagtttaaattaacgtttagttttccgtacgggttacgttacggggttttacggggccggggtaaggggaaccggtaaggggttcgggaaagttacgtaaccggtaaagggttacggttgggttcgggtaacttcggaaccgtaccgttattccttcggttaacctttccg

SEQ ID NO: 365285 - DNA, 538 bp, Homo sapiens
  misc_feature: GZ8MTXP01CBESC.2.1.A01.1.454.CMB.2.raw
  modified_base (222)..(222): a, c, t, g, unknown or other
  modified_base (349)..(349): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggcagtcaanatgttaatattggttgcctggtatcagcagaaaccagggaaacgcccctaaactcctgatctctgatgcctaccatttggaaagtgggtcccatcaaggttcacccggcagtggatcgtgggacaanagttcactctcacatcagcaggcctgcagcccgatgactttgctatcttattactgaccctaaacagttaataagttacgtttcgtacggttctaaggttttcgggcgggaaggggtaacgaagggttgggaagttagtacgaaagggttacgttggttacggctagcaccgtattccttcgttcttcc

SEQ ID NO: 365286 - DNA, 616 bp, Homo sapiens
  misc_feature: GZ8MTXP01CIHRD.2.1.A01.1.454.CMB.2.raw
  modified_base (222)..(222): a, c, t, g, unknown or other
tcagacgctcgacacacgaccggtgctcgatttagacgtctcatcagggggagtcagactcagtcaggatacagcatggacatgagggtccccgctcagctcctggggctcctgctgctctggctcccaggtgccaaatgtgacatccagatgacccagtctccttccaccctgtctgcatctgttggagacagagtcattatcacttggccggcagtcaanatgttaatattggttggctggtatcagcagaaaccaggaacgcccctaaactcctgatctctgatcgcctactaagtttagggaaagtcgggggtacccagtcgaaggttcaccccggctaggtggatcgtagggacaactagttaccactctccaccatcacgcacgctgccaggccccaagttcgtactttcgctaacttcttaattactagaccctaaactaagttaattaagttacgtttcttacgggttacgtaggtttccggggacgggtaaggggaacgggtaaagggttgggtaaagttacgtaaacgggtaaaagggttaaccgttgggttacggtaaccgttcggaaccctaaaccgtcttccgttcggttccgttttaacccg

SEQ ID NO: 365287 - DNA, 652 bp, Homo sapiens
  misc_feature: GZ8MTXP01EU948.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagatcattatcacttgccgggccagtcaacatagttaatattggtggctggtatcagcagaaacagggaaacgcccctaaactcctgatctctagatcgcctaccgtaagtttagggaaaggttcgggggtacccagtaccgtaaggttccaacccggctaggtggatcgtaacgggaactaacgtagttaccactcctacacctagttaccaagtccaacggccctaggccacggaccccgaatcgtaactttcgctaattctttaattaccgtacgaacctaaacgtaagttaacttaaagttacgtttcgtacgggttacgtaacggtttcggggaccgggtaagggaacgggtaaggggttggtaaaggttacgtaacggaaaaagggttaccgttgggttacgggtcgttacggaaccctaaacgtacttacgtttcggtttaacccgtttcccg

SEQ ID NO: 365288 - DNA, 654 bp, Homo sapiens
  misc_feature: GZ8MTXP01B8QQ9.2.1.A01.1.454.CMB.2.raw
tcagacgctcgacacacgaccggtgctcgatttagacgtctcatcaggggggagtcagactcagtcaggacacagcatggacatggagggtccccgctcagctcctggggctcctgctgctctggctcccaggtgccaaatgtgacatccagatcgacccagtcctccttccaccctgtctgcatctggtggagacagagtcattatcacttcggccgggccagtacaactatagttaaatagttggttcgctggtatcgagacaaggaaaccgaagggaaactaccccctaaactcctagactctctgactcgacccttacgtaagtttagggaacgtcgggtacccagtcgaaggttccgaccggcaggtggatcgtaaggactgacttcactctcacatcacgcgacgccgtagaccacggacccgtattacgtactttcgacttacttactttaacttacgtacgtaacctaaacttaagttaaacttaagttcggtttacgtcgggttaccgtaggggtttccgggaacggggtagggtaaacgggtaaggggttgggtaaagttaacggttaaacggaaacgggttagttccgggttaggtaaccgtacgaaccgttaaccgtcgtttcttccggtttctttaacccg

SEQ ID NO: 365289 - DNA, 656 bp, Homo sapiens
  misc_feature: GZ8MTXP01AG77V.2.1.A01.1.454.CMB.2.raw
  modified_base (266)..(266): a, c, t, g, unknown or other
  modified_base (350)..(350): a, c, t, g, unknown or other
  modified_base (366)..(366): a, c, t, g, unknown or other
  modified_base (612)..(612): a, c, t, g, unknown or other
tcagacgctcgacacacgaccggtgctcgatttagacgtctcatcaggggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacatagtaatatggttggctggatcagcagaaaccagggaaacncccctaaatcctagactctctgatcgccttccaatttgggaaagttcggggtccagtcgaaggttccacccggactgtgggtancgttagggaactaacngtccactctcaccatcacgcctagacccgtgcacgaccccgtatacgtactttaggcctacttaccgtttaattaccgttacgtaccccgtaaactaaacgttaacgtaaactttaggtttaaccgtttaccgggttacgtaaccgggttttccggggtacggggtaacgggggtaacgggtaaacggggttaggggaaacggttagttaaaccgaaaagggttaaacgttcgggttacgggtcgngtaacccgtacccggaattccccgttaacggttccgtttaaccc

SEQ ID NO: 365290 - DNA, 505 bp, Homo sapiens
  misc_feature: GZ8MTXP02G0SXB.2.1.A01.1.454.CMB.2.raw
  modified_base (221)..(221): a, c, t, g, unknown or other
  modified_base (341)..(341): a, c, t, g, unknown or other
  modified_base (366)..(366): a, c, t, g, unknown or other
tcagacgctcgacacacgaccggtgctcgatttagacgtctcatcaggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggcagtcaanatgttaatattggtgctggtatcagcagaaaccagggaaagcccctaaatcctgatctctgatgcctcaatttggaaagtgggtcccatcaaggttcacccggcagtggatcgtgggacncgagttcactctcacatcagcagcngcagcccgatgactttgcatcttatactgaccaatagtataatagtttctacggtctaggtttcggacggagggtacgaaagggtggaagtagtacgaaaggtaactggtacggctaggcaaccgatcctgttactttc

SEQ ID NO: 365291 - DNA, 265 bp, Homo sapiens
  misc_feature: GZ8MTXP02HZBTX.2.1.A01.1.454.CMB.2.raw
  modified_base (238)..(238): a, c, t, g, unknown or other
  modified_base (255)..(255): a, c, t, g, unknown or other
  modified_base (261)..(265): a, c, t, g, unknown or other
tcagacgctcgacacacgaccggtgctcgatttagacgtctcatcaaggttcaccggcagtggatctgggacacagttcactctcaccatcagcagcctgcagcccgatgactttgcatcttattactgccaacagtataatagtttctcggtcagtttcggcggaggacgaaggtggagatcaaaggactgtggctgcaccatctgtctcatcttcccgcatctgatgtcgagcgtngagcggctggcaaggcncatagnnnnn

SEQ ID NO: 365292 - DNA, 493 bp, Homo sapiens
  misc_feature: GZ8MTXP02JP6XX.2.1.A01.1.454.CMB.2.raw
  modified_base (346)..(346): a, c, t, g, unknown or other
  modified_base (406)..(406): a, c, t, g, unknown or other
  modified_base (484)..(484): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacatgttaataattggtgcctggtatcagcagaaaccagggaaagcccctaaatcctgatctctgatgcctccaatttggaaagtgggtcccatcaaaggttcacccggcagtggatctgggacncagttcactctcaccatcagcagcctgcagcccatgactttgcatcttatactgaccaanagtataattagtttctcggtcaggtttcggacggagggtacgaaaggtggagatacgaaagactgtggctgcaacctntctcgtctc

SEQ ID NO: 365293 - DNA, 583 bp, Homo sapiens
  misc_feature: GZ8MTXP02F3YDL.2.1.A01.1.454.CMB.2.raw
  modified_base (341)..(341): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccggccagtcaacatgtaatatggttgctggtatcagcagaaaccaggaaacgcccctaaactcctgatctctgatgcctccaatttggaaagtggggtccatcaaggttcacccggcagtgatctgggacncagtcactctcacatcagcagcctgcagcccgatcgactttgactattcttacttactcgacctaaactagttaataaacgttagtttactcgggttactaggtttaccgggacggggtaaggggtaaccgggtaaaggggttagggaaggtaaacgttaaccggtaaaaggggtaaaccgttgggtacgggtaacgttacggaccgtaaccctaacgttaccgttcggtttacctttaccg

SEQ ID NO: 365294 - DNA, 504 bp, Homo sapiens
  misc_feature: GZ8MTXP02GQL3Y.2.1.A01.1.454.CMB.2.raw
  modified_base (190)..(190): a, c, t, g, unknown or other
  modified_base (382)..(382): a, c, t, g, unknown or other
  modified_base (402)..(402): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttgganacagagtcattatcacttgccgggccagtcaacatgttaataatggtgctggtatcagcagaaaccagggaaacgcccctaaactcctgatctctgatgcctcaatttggaaagtcggggtcccatcaaggttcacccggcagtggatctgggacacgagttcactctcacatcagcagctgcagcccgatnacttgctattcttattactnacaacagttataattagtttactggtactaggtttcggcggagggaacggaaggtggagatacgaaaggaactggtaggcgtgacgaccagtctcgtcttac

SEQ ID NO: 365295 - DNA, 580 bp, Homo sapiens
  misc_feature: GZ8MTXP02H5ZBD.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctcccttccacctgtctgcatctgttggagacagagtcattatcacttggccgggcagtcaatatgttaatagttggtggcctggtatcagcaagaaaccagggaaacacccctaaatcctagactctctgactgcctactaagtttgggaaacgtgggtacccaagtcgaaaggttcacccggcagtggatcgtaggactcgagttcaccttcaccacactcacgacagcccgtgccacgcccgtatcgaactttgctattctttaacttactacgactaaactagttaaacttaattacgttcgttacggtcgtaacggtttcgggacggggtaagggtacggtaaaggggttggaagtaaacgtagaaaacggtacttgggacgtcgtcgaacctacgtattaccgttcgttactcg

SEQ ID NO: 365296 - DNA, 529 bp, Homo sapiens
  misc_feature: GZ8MTXP02ICVKF.2.1.A01.1.454.CMB.2.raw
  modified_base (190)..(190): a, c, t, g, unknown or other
  modified_base (432)..(432): a, c, t, g, unknown or other
  modified_base (485)..(485): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttgganacagagtcattatcacttggccgggccagtcaacatgttaatagttggttggcctggtatcagcaagaaaccagggaaacgccccctaaatcctagactctctgatcgcctaccaagtttgggaaaggttcggggtaccccaagtcgaaagggttccaccccgggcaggtggatcgtagggacacagttcactctcacatcagcagccctgcacgcccgatcgactttgctattcttatacngacaatagtataatgttcgtcgtctaggttcggacggagggacgaggtggaanacgtaacgaaaggtactggtcgctcgacactatctagtcttacc

SEQ ID NO: 365297 - DNA, 607 bp, Homo sapiens
  misc_feature: GZ8MTXP02IPHMO.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctcccttccaccctgtctgcatctgttggagacagagtcattatcacttgccgggccagtcaacatgttaatattggttgctgtatcagcagaaaccaggaaacgcccctaaactcctgatctctgatcgccttacctaagttttagggaaaggttcggggtacccccagttaccgtaaagggtttccaaccccgggtcaggtgggtattcgtggggaacctcgtagttccactcctaccacatcagcacgcctgcacgcccgatcgtactttgactattactttacttacctacgacctaactagttaattaattacgtttcgtcggttacgtaggtttcggggacgggtaacggggtaacggtaaggggttaggaaggtaaacgtaacggaaaagggtaacgtgggttacggcgtcgaccgtacctattccgttcgttctttacg

SEQ ID NO: 365298 - DNA, 672 bp, Homo sapiens
  misc_feature: GZ8MTXP02IYDDG.2.1.A01.1.454.CMB.2.raw
  modified_base (242)..(242): a, c, t, g, unknown or other
  modified_base (259)..(259): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccggcagtcaacatgttaatattggtgctgtancagcagaacaggaaacnccctaaactcctgatctctgactcgcctacctaagtttagggaaacggttcggggtacccctaagttaccgaaacgggtttccaaccccgggtactagggtggtaacttcgtaggggaacctacgtacgtttccaactcctaccaactatccgaagctacgcctagccacgtcccgattacgtaccgtttgacttactttactttaacttaccgtacgtaacctaaacgttaagttaaatttaacgtttacgtttaccgttacggttacgttacgggtttaccggggacggggtaaacggggtaacgggtaaaggggtagggtaaacggtaaacgttaaacggtaaaacggtaacgttgggtacggtaacgtacgaacctaaccgtacgtttaccgttacgtttacctttacg

SEQ ID NO: 365299 - DNA, 541 bp, Homo sapiens
  misc_feature: GZ8MTXP02HQFSY.2.1.A01.1.454.CMB.2.raw
  modified_base (191)..(191): a, c, t, g, unknown or other
  modified_base (455)..(455): a, c, t, g, unknown or other
tcagacgctcgacacacgaccggtgctcgatttagacgtctcatcagggggagtcagactcagtcaggatacagcatggacatgagggtccccgctcagctcctggggctcctgctgctctggctcccaggtgccaaatgtgacatccagatgacccagtctcccttccaccctgtctgcatctgttgganacagagtcattatcacttgccgggcagtcaacatgttaatattggttggcctggtatcagcaagaaaccagggaaacgcccctaaactcctgatctctgatgcctcaatttggaaagtgggtccatcgaaggttcacccggcagtgatcgtgggacactagttcactctcaccatcagcacgctgcacgcccgtatgtacttgctatctttattactcgtaccaactagttaataattacgtttctacggtctaggtttcgggngggtaagggtacggaaggggttagggagtaagttaacgaaaaggtaactgggtggaacttggactacagtttctcgttctttaccg

SEQ ID NO: 365300 - DNA, 571 bp, Homo sapiens
  misc_feature: GZ8MTXP02G4F10.2.1.A01.1.454.CMB.2.raw
  modified_base (224)..(224): a, c, t, g, unknown or other
  modified_base (459)..(459): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacntagttaatagttggtgctggtatcagcagaaaccaggaaacgcccctaaacgtcctgactctctgacttcgccttacctaagtttagggaaaacggttcggggtacccctaagttaccgaaacgggtttccaaccccgggtcaggttcggaatcgtaggggacacgtagttaccactctaccaacatcaagtcacgcctgaccacgcccgatcgtacttgctattacttattacncgtacaactagtataacttgtttctcggtactgttccgggaggtacgggacgtagggtgaacgatacgaaaaggtactggtacgcgtcgactaccgattccgtgttcttacg

SEQ ID NO: 365301 - DNA, 681 bp, Homo sapiens
  misc_feature: GZ8MTXP02G49SU.2.1.A01.1.454.CMB.2.raw
  modified_base (191)..(191): a, c, t, g, unknown or other
  modified_base (270)..(270): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtcctccttccaccctgtctgcatctgttgganacagagtcattatcacttggccgggcagtcaacatagttaatagttggtgcctggtatcagcaagaaaccgaggaaacncccctaaactcctgatctctagactcgacctaccgtaagtttacgggaaaggtcggggtacccaagtaccgtaaacgggtttccaaccccggggtcgtaggttacggaacttccggtaggggaacctacgtacgttccaaccttcctaccacctatccagcaacggtccctggaccacgcccgtatacgtaactttcgacttattaccttaacttacctcgtaaccctaaatagttaattaacgtttacgtttccgtacgggttacgttagggtttaccggggaggggtaacggggtaacggtaaggggttagggaaacggtaaactaacgggtaaaacgggaaccggttggtacggtaaccgttacggaacccgttaacccgtatttccgttacggtttactttaacccg

SEQ ID NO: 365302 - DNA, 518 bp, Homo sapiens
  misc_feature: GZ8MTXP02HEA7M.2.1.A01.1.454.CMB.2.raw
  modified_base (265)..(265): a, c, t, g, unknown or other
  modified_base (345)..(345): a, c, t, g, unknown or other
  modified_base (403)..(403): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacatgttaatattggtggctggtatcagcagaaaccaggaaacncccctaaatcctgatctctgatgcctcaatttggaaagtgggtcccatcaaggttcacccggcagtggatcgtagggacncagttcactctcacatcagcagcctgcacgcccgatgactttgactattcttattacngtaccaaacagttaataaattagtttctacggtctagggtttcgggcgggtagggaacgaagggtggagtaagtacgaaaagggactggtaggctgacaccgatcctgtactttc

SEQ ID NO: 365303 - DNA, 526 bp, Homo sapiens
  misc_feature: GZ8MTXP02F0UMG.2.1.A01.1.454.CMB.2.raw
  modified_base (344)..(344): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacatgttaatatggttgctggtatcagcagaaaccagggaaagcccctaaactcctgatctctgatgcctccaatttggaaagtggggtcccatcaaggttcacccggcagtgatctgggacncagttcactctcacatcagcagctgcagcccgatgactttgacattcttattactcgaccaaactagtaactaattagtttactcggtctaggtttcgggcgggaagggacggaaggttggagaaagtacgaaaacggtaacgtggttaggcgttggaccaacgtatctacggttctttaac

SEQ ID NO: 365304 - DNA, 564 bp, Homo sapiens
  misc_feature: GZ8MTXP02GCBVI.2.1.A01.1.454.CMB.2.raw
tcagacgctcgacacacgaccggtgctcgatttagacgtctcatcagggggagtcagactcagtcaagacacagcatggacatgagggtccccgctcagctcctggggctcctgctgctctggctcccaggtgccaaatgtgacatccagatgacccagtctccttccaccctgtctgcatctgttggagacagagtcattatcacttgccgggcagtcaacatgttaatattggtgctgtatcagcagaaacaggaaacgacccctaaactcctgatctctgatgcctcaatttggaagtcggggtccatcaaggttcacccggcagtggatcgtagggacacgtagttcactctacacatcagcagctgcagcccgatcgtactttgactattcttatactagaccaatagtaataattacgtttacgtcggttactacgggtttacgggacgggaacggggtaacggtaaggggtagggtaagtaagtaaccgtaaaaggggaaccgttgggtacggtaacgttcggacctacccgtagttaccttcggttacctttaccg

SEQ ID NO: 365305 - DNA, 513 bp, Homo sapiens
  misc_feature: GZ8MTXP02JP2U2.2.1.A01.1.454.CMB.2.raw
  modified_base (386)..(386): a, c, t, g, unknown or other
  modified_base (444)..(444): a, c, t, g, unknown or other
  modified_base (489)..(489): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtcctccttccaccctgtctgcatctggttggagacagagtcattatcacttgccgggcagtcaacatgttaatattggtggcctggtatcagcagaaaccagggaaacgccccctaaatccctgactcgtctgatgcctcctaaagtttgggaaagtggggtacccatcgaaggttcacccggcaggtgatcgtgggacacagttcactctcaccatcagcagcctncgcgcccgatcgtacttgcctatcttacttctcgacaactagtatattgttactcgtntagttggcggtagggacgaggtggaagagtacgaaagactggagngaggctaccgtatcgtcgtcttac

SEQ ID NO: 365306 - DNA, 548 bp, Homo sapiens
  misc_feature: GZ8MTXP02G53WZ.2.1.A01.1.454.CMB.2.raw
  modified_base (246)..(246): a, c, t, g, unknown or other
  modified_base (337)..(337): a, c, t, g, unknown or other
  modified_base (346)..(346): a, c, t, g, unknown or other
  modified_base (352)..(352): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccgggccagtcaacatgttaatattggtgctggtatnagcagaaaccagggaaacgcccctaaactcctgatctctgatcgcctaccaatttagggaaagtggggtccccagtcaaggttcacccggnagtgatcgngggacnctagttcactctcacatcagcagcctgcagcccgatgactttgctattcttattactcgactaactagttaataagttagtttacgtcggtcgttaaggtttcggggacgggtaaggggtaacgtaagggtgggaagtagtaacgaaacgggtaactggtacggcttcggacctacctaagtcttacgttcttacc

SEQ ID NO: 365307 - DNA, 649 bp, Homo sapiens
  misc_feature: GZ8MTXP02HSWVU.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctcccttccaccctgtctgcatctgttggagacagagtcattatcacttgccggcagtcaacatgttaataattggtgctggtatcagcagaaaccaggaaacgcccctaaactcctgactctctgatcgcctacctaagtttgggaaaggtcggggtaccccagtaccgtaaaggttccgaaccccgggtcaggtggtaactcgttacggggactacgtacgtttccaaccttcctaccaacctactcaacgctaacgcccgtagcccgacggtccccgtaagttcgtaactttcgaccttattacctttaacttacctacgtaaccctaaattagttaaattaaagttacgtttcgttaccggtcttaacgggtttcgggaccggggtaagggtaacggaaggggttggaaagtacgttaacggaaaaggtaccgttagggtcgtaacgtacgaccgtaccctagttccttacgtttcctttaaccg

SEQ ID NO: 365308 - DNA, 720 bp, Homo sapiens
  misc_feature: GZ8MTXP02I831H.2.1.A01.1.454.CMB.2.raw
  modified_base (268)..(268): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccacctgtctgcatctgttggagacagagtcattatcacttggccggcagtcaactattgttaatagttggttggctggtatcagcagaaaccgaggaaacncccctaaactcctagactctctgactcgcctactaagtttagggaaacggttcggggtaccctagtaccgtaaacgggtttccaacccccgggacgtacgggtcggtaacgttacggtacgggggaaccaccgtaacggtttaccctaccttacccttaccgaaccctaacttaccgaacggtacccacggtaccccgttcgggacccaccgggtaccccgtacgttacggttaaccttttcggacctaacgtttacctttaacctttaaccgtacgtaaccccgtaaataacggtttaaattaagtttacgtttccgttacgggtttacgtacgggtttacgggggacgggtaacggggtaacggtaagggtagggaagtaaacgtacggaaaacgggtacgtaggtacggtaaccgtcggactaaccggttatcgttacgttaccgtacg

SEQ ID NO: 365309 - DNA, 610 bp, Homo sapiens
  misc_feature: GZ8MTXP02JG8TA.2.1.A01.1.454.CMB.2.raw
  modified_base (203)..(203): a, c, t, g, unknown or other
  modified_base (261)..(261): a, c, t, g, unknown or other
  modified_base (345)..(345): a, c, t, g, unknown or other
  modified_base (367)..(367): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattancacttgccggccagtcaacatgtaatattggtgctgtatcagcagaaacagggaaacncccctaaatcctgatctctgatgcctactaagtttgggaaaggtcggggtaccccataccgtaaacgggtttccaccccgggtnaggtggactcgtacggggaacnctagttcacttcctacaccatcacgcaacgctgccacgcccgtatcgtaactttgactattacctttagttactcgacctaaacgtagttaaattactttaaggtttcctacggtacgtagggtttacgggacggggtaaggggtaaacgtaggggttaggaaacggtataaacgggtaaaagtaaccgttgggtaacggtcgtacggacctaacccgttagttccgtttcgttacctttacg

SEQ ID NO: 365310 - DNA, 663 bp, Homo sapiens
  misc_feature: GZ8MTXP02I12SO.2.1.A01.1.454.CMB.2.raw
  modified_base (191)..(191): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtcctccttccaccctgtctgcatctgttgganacagagtcattatcacttcggccgggcagtcaactattagttaatagttggtggcctggtatcagcaagaaaccgagggaaacgacccctaaactcctagactctctagatcgacctacgtaagtttacgggaaaggtcggggtaccccaagttaccgtaaacggtttcccgaaccccgggctaacggtagggtaacgttcggtacggggaaaccaccgttacggttacctaaccttcctaccaaccattaccgaggccaacgtccctacgaccgaaccgcccgtaatcgtaactttgacttattactttagtacttacgaccctaaatagttaattaacgtttagttaccgtacggttacgttaagggtttcccgggaggggtaagggacggtaagggtaggtaacgagttaaacgaaacggtaacgttgggacgtaacgtacgacctaccgattccgtcgttacttaccg

SEQ ID NO: 365311 - DNA, 632 bp, Homo sapiens
  misc_feature: GZ8MTXP02JWRBB.2.1.A01.1.454.CMB.2.raw
  modified_base (224)..(224): a, c, t, g, unknown or other
  modified_base (247)..(247): a, c, t, g, unknown or other
  modified_base (275)..(275): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtcctccttccaccctgtctgcatctgttggagacagagtcattatcacttggccgggcagtcaanatagttaatagttggtgctgtancagcaagaacgaggaacaccctaactcngatctctgactcgcctacgtaagtttagggaaacggtcggggtaccctaagttacgaacggttccgacccggtcgaggtaggtactcggtacgggactacgtacgttcctaacttccaccaacctatacagacacgccctgaccgacgtcccgtatacggttacttgacttacttacttattacctacgtaacctaaatagttaattaacgttacgtttacgtacgggttcgttagggtttccggggacggggtaagggtaaacgggtaagggtacggaaggtaacgtaaacggtaaaaggtacgttggtacgggtaacctcggtacctaccgttaagttcgttacttacgtttacc

SEQ ID NO: 365312 - DNA, 655 bp, Homo sapiens
  misc_feature: GZ8MTXP02H00VG.2.1.A01.1.454.CMB.2.raw
  modified_base (190)..(190): a, c, t, g, unknown or other
  modified_base (203)..(203): a, c, t, g, unknown or other
  modified_base (272)..(272): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtcctccttccacctgtctgcatctgttgganacagagtcattancacttggccggcagtcaactattagttaataagttggtgcctggtatcagcaagaaaccgagggaaacnccccctaaatcctagacttctacgtgaactcgccctacgtaaaagttttacggggaaaacggttcggggtaccccaagttaccggtaaaacggggttccgaaaccccccggggtgtaaggttacggggtacttcggtaaggggacctacgtacgtttacaccttcacacctaatccagcagccctgccagcccgatgtactttgactattcttaattacagtaccaaatagtaaacttaagtttacgtttaccgacggtttacgtacgggtttcggggaaccggggtaaaggggtaaccgaaaaggggttgaaacgtaagtaaccgaaaaagggtaactttggacgggtctacgactacccgaatttcgtacgttcttacccg

SEQ ID NO: 365313 - DNA, 727 bp, Homo sapiens
  misc_feature: GZ8MTXP02HEB99.2.1.A01.1.454.CMB.2.raw
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtcctcccttccaccctgtctgcatctgttggagacagagtcattatcacttgcccgggcagtcaactatagttaattaagttggttggcctggtatcagcaagaaaccgaggaaacacccctaactcctgactctctagtactcgaccttctaaagtttcgggaaagttcggggtaccctaagtacgtaaacggttccgaaccccgggctaacgggtggacttacggttaggggaaccacgttaccggtttacaacctttcctacccaaccaacttcgacgaccgtaaccgtccgtcggaccgaaccgtcccccggtaattcggtttaaccgtttagtacctaacgttttacctttaaacgtttaaacctcggtaaacccctaaaagttaccttttaaaagtaacgttttaacgtttccggttacggggttacgtacggggttttacccgggggaggggtaaaaccgggggtaagggttaaggggttaggaacgtaaaacggtacggtaaaacgggtacggtcgttaaggcgttacggaccctactagtcccttaggtaccctttccg

SEQ ID NO: 365314 - DNA, 692 bp, Homo sapiens
  misc_feature: GZ8MTXP02F9439.2.1.A01.1.454.CMB.2.raw
  modified_base (192)..(192): a, c, t, g, unknown or other
  modified_base (205)..(205): a, c, t, g, unknown or other
tcagacgctcgacacacgaccggtgctcgatttagacgtctcatcaggggggagtcagactcagtcaggacacagcatggacatgagggtccccgctcagctcctggggctcctgctgctctggctcccaggtgccaaatgtgacatccagatgacccagtctcccttccaccctgtctgcatctgttgganacagagtcattancacgttggccgggccagtacaacattagttaaatagttggttggcttggtatcagacacgaaaacgagggaaacacccctaaaactccgtgaacttctctgtaactcggacccttaccgtaaagtttagggaaaaggttcggggtaccccaatccggtaaaacggtttccaaccccggtctaaggttggaacgttcggtcggggaacacgttacgttacaccttcctaccaaccagttacgaaacgccaaaggtcccgtacggccaacgggaccctagttcgttaactttcgactacttactttaagttacctacgtaaccaaacggtatttaactaacgtttacgtttcgtacggtacgttacgggttaccgggaggggtaaggggttaaaccggaacggggttaggaaccgtaaagtaacgaaaacgggtacgtggttaacgggccttaggaccgtaaacccgtttataccggttacttacttac

SEQ ID NO: 365315 - DNA, 560 bp, Homo sapiens
  misc_feature: GZ8MTXP02FPI81.2.1.A01.1.454.CMB.2.raw
  modified_base (221)..(221): a, c, t, g, unknown or other
  modified_base (275)..(275): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacttgccggcagtcaantgtaatatggtgctgatcagcagaaaccaggaaacgacccctaaactctgatcnctgatgcctcctaaagtttagggaaaagtcgggggtaccccagacaacggttcaccccggcagtgatcgtgggactacacgttacactctacacctaatcagccagccctgcacgcccgaatgtaactttgacctattcttaatactcgaccaaactaagtaattaactagttttactacgggttctaggtttacgggacgggaacgggggaacggtaaaggtgggaaacgtagtaacgaaaacggtaacgtggtagcgtagacacccattactcgtctttaccg

SEQ ID NO: 365316 - DNA, 847 bp, Homo sapiens
  misc_feature: GZ8MTXP02HW606.2.1.A01.1.454.CMB.2.raw
tcagacgctcgacacacgaccggtgctcgatttagacgtctcatcagggggagtcagactcagtcaggacacagcatggacatgagggtcccccgctcagctcctggggctcctgctgctctggctcccaggtgccaaatgtgacatccagatgacccagtcctcccttccaccctgtctgcatctgttggagacagagtctattatcacttcggccgggccagtacaactattagttaaattaagttgggttggccttggtatcgagacaacgaaaaccgaagggaaaccgaccccctaaaacgtcctagactctctgactcgacctacgtaagtttagggaaacggttcggggtacccagtaccgtaaacggttccgaaccccgggtcgtaggtacggtacttacggtacggggaacctacgtacgtttaccaccttccgtaccaccctaactaccgacgtaccgtaaccggtcccgttaggacccgtaacccgggtaccccgttaaaggtttccgttaaaccgtttttcggaaccttaaacgtttttaaccttttaaacctttaaccgttaaccggtaaacccttaaaaaccgttaagggtttaaaacctttaaacggtttaccggtttttaccggttacccggggtttaacggtttaccgggggttttaccggggggaaaccgggggttaaaacgggggttaaaccggggttaaaacgggggttggggtaaaacgttaaaaccggggtaaaacggtaaaaacggggttaaccggtttggggtaaccggtccgttaacggaacccttaccgtaacgtttccgttacggtttaccctttaacccg

SEQ ID NO: 365317 - DNA, 703 bp, Homo sapiens
  misc_feature: GZ8MTXP02GITEG.2.1.A01.1.454.CMB.2.raw
  modified_base (389)..(389): a, c, t, g, unknown or other
tcagacgctcgacacacgaccggtgctcgatttagacgtctcatcagggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcattatcacgttgccggccagtcaactatgttaataagttggttggccttggtatcgagcaagaaaccagggaaacgcccctaaactccctgaatctctgatcgacctacgtaatttagggaaacggtcggggtacccagtacgtaacggttccgaaccccgggcgtagtaggtacttcggtacggggaacnccgtagttccgtacttcctaccaaccctagttcaaaccggctacggcccgttacgcgaaccggtccccgtaattcggtaacttttcggaccttactttacctttaacttacctaccggtaccaaacgttaagggttacttaaaacggtttcgttttacccggtcggtttacgttacggggttttcccgggaaagggggtaccggggtaaaacggtaacgggggttgggaaaccggttaaagtaacccgtaaaagggtaaccgttggtacggtaacgtcgtacctaaaccgttagttccgtttacgttcttaccg

SEQ ID NO: 365318 - DNA, 481 bp, Homo sapiens
  misc_feature: GZ8MTXP01AUP84.51.67.G01.1.454.CMB.2.raw
  modified_base (311)..(311): a, c, t, g, unknown or other
  modified_base (397)..(397): a, c, t, g, unknown or other
  modified_base (459)..(459): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacnggggtccatcaaggttcagtggaaagtggctctgggacagattttacttcaccatcagcaggctgcagcctgaagacattgcaacntaattactgtacaacagtatgatagtctccgctcacgtttcggcgggggaccaaggtggagnttcaagcgaatgtggctgcaac

SEQ ID NO: 365319 - DNA, 500 bp, Homo sapiens
  misc_feature: GZ8MTXP01D80JZ.51.67.G01.1.454.CMB.2.raw
  modified_base (192)..(192): a, c, t, g, unknown or other
  modified_base (310)..(310): a, c, t, g, unknown or other
  modified_base (472)..(472): a, c, t, g, unknown or other
  modified_base (490)..(490): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcagtcgagacattagcatgtatctgaattggtatcagcaaaaaccagggacagcccctaaactcctgatcctcgatgcatccactttggaaacnggggtccatcaaggttcagtggaaagtgggctgtgggacagtattttacttcaccatcagcaggctgcagcctagaagacattgacaacattattactgtacaacagtatagatagtcctcccgctcgtacgtttcggggcgggggttaccaagggtggagnttcgaagcgaagttgggngctcgctaac

SEQ ID NO: 365320 - DNA, 511 bp, Homo sapiens
  misc_feature: GZ8MTXP01D9UVM.51.67.G01.1.454.CMB.2.raw
  modified_base (192)..(192): a, c, t, g, unknown or other
  modified_base (445)..(445): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgaattggtatcaagacaaaaaccagggacagacccctaaactcctgatcctcgatgcatccatttggaaacaggggtcccatcaaggtcagtggaaagtggctctgggacagtattttacttcaccatcagcaggctgcagcctgaaagacattagacaaacgtattaattacctagttacaaactagtatgatagtctcccgntcacgtttcgggacgggggacgaagggtggagattacaaggcgaacgtgtcgggctcggctaaccg

SEQ ID NO: 365321 - DNA, 509 bp, Homo sapiens
  misc_feature: GZ8MTXP01ED70H.51.67.G01.1.454.CMB.2.raw
  modified_base (192)..(192): a, c, t, g, unknown or other
  modified_base (315)..(315): a, c, t, g, unknown or other
  modified_base (368)..(368): a, c, t, g, unknown or other
  modified_base (395)..(395): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcagtcgagacattagcatgtatctgaattggtatcaagacaaaaaccagggacacgacccctaaactcctgatcctcgatgcatccactttaggaaacngggtcccatcaagttcagtggaaagtgctctgggacagtatttacttcacatnagcaggctgcagcctagaagacattanacaacaatattactagtacaacagtatagtatagtctccgtctcgtacgttcgggtcgggggttaccggaagggtaggagagttacgaagacgaacgtagtgcgtcgcgtaacc

SEQ ID NO: 365322 - DNA, 499 bp, Homo sapiens
  misc_feature: GZ8MTXP01DQVGQ.51.67.G01.1.454.CMB.2.raw
  modified_base (413)..(413): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcaagacaaaaaccaggacagacccctaaactcctgatcctcgatgcatccactttggaaacagggtccatcaagttcagtggaaagtgaactctgggacagtatttacttcaccatcagcaggctgacagcctgaagacattagacaacatatactatacaanatatagtatagtactccgtctctacgttcggtcgggggaccggaaggtaggagagttacaagacgaacgtagtggcgtcgcgaacc

SEQ ID NO: 365323 - DNA, 505 bp, Homo sapiens
  misc_feature: GZ8MTXP01DDKXO.51.67.G01.1.454.CMB.2.raw
  modified_base (192)..(192): a, c, t, g, unknown or other
  modified_base (311)..(311): a, c, t, g, unknown or other
  modified_base (436)..(436): a, c, t, g, unknown or other
  modified_base (472)..(472): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgaattggtatcagacaaaaaccaggacagcccctaaactcctgatcctcgatgcatccactttggaaacngggtccatcaaggttcagtggaaagtggctctggggacagtatttactttcaccatcagcaggctgcagcctgaagacattagcaaacattaattactgtacaaatagtatagatagtctcccgntcacgtttcggggcgggggaccgaaagggtggaagnttacgaaaggcgtaacgtgtgggctgctaaccg

SEQ ID NO: 365324 - DNA, 493 bp, Homo sapiens
  misc_feature: GZ8MTXP01DE46D.51.67.G01.1.454.CMB.2.raw
  modified_base (191)..(191): a, c, t, g, unknown or other
  modified_base (313)..(313): a, c, t, g, unknown or other
  modified_base (397)..(397): a, c, t, g, unknown or other
  modified_base (433)..(433): a, c, t, g, unknown or other
  modified_base (466)..(466): a, c, t, g, unknown or other
  modified_base (482)..(482): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccgggcgagtcgagacattagcatgtatctgaattggtatcaagacaaaaaaccagggacagcccctaaactcctgactcctcgatgcatccatttggaaacngggtccatcaaggttcagtggaaagtgctctgggactagtatttacttcaccatcagcaggctgcagctgaagacattgacaanattattactgtacaacagtatagatagtcctcccgntaacgcgtttcgggcgggggaccaagggtgagnttacaagcgaactggnggctgctaacc

SEQ ID NO: 365325 - DNA, 516 bp, Homo sapiens
  misc_feature: GZ8MTXP01D4WZB.51.67.G01.1.454.CMB.2.raw
  modified_base (403)..(403): a, c, t, g, unknown or other
  modified_base (426)..(426): a, c, t, g, unknown or other
  modified_base (433)..(433): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccagggacagacccctaaactcctgatcctcgatgcatccactttaggaaacaggggtcccatacaaggttcagtggaaagtggctcgtgggactagtattttacttcaccatcagcaggctgcagcctagaagacattanacaacgaataattactatacaanagtatanatagtactccgtctctacgttcgggtcggggaccggaagggtaggagagttacgaagacgaacgtagtggcgtcgcgtaaccg

SEQ ID NO: 365326 - DNA, 527 bp, Homo sapiens
  misc_feature: GZ8MTXP01CHRZ2.51.67.G01.1.454.CMB.2.raw
  modified_base (485)..(485): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagacaaaaaccagggacacgacccctaaactcctgatcctcgatgcatccactttggaaacgtacggggtccactcgaaggttcaggtggaaagtggctcgtgggactagtatttacttcaccatcagcaggctgcagctgaagactatgacaacattattactgtacaactagtatagattacgtcctcccgctctacgtttcggggacgggggaccgaaagggtcggaagnttacgaaggtacgaacgttcggtcggacttcggccgtaaccg

SEQ ID NO: 365327 - DNA, 823 bp, Homo sapiens
  misc_feature: GZ8MTXP01EYQYW.51.67.G01.1.454.CMB.2.raw
  modified_base (171)..(171): a, c, t, g, unknown or other
  modified_base (180)..(180): a, c, t, g, unknown or other
  modified_base (185)..(185): a, c, t, g, unknown or other
  modified_base (201)..(201): a, c, t, g, unknown or other
  modified_base (252)..(252): a, c, t, g, unknown or other
  modified_base (435)..(435): a, c, t, g, unknown or other
  modified_base (451)..(451): a, c, t, g, unknown or other
  modified_base (679)..(679): a, c, t, g, unknown or other
tcagcgatcgtatacacgaccggtgctcgatttagagtatacatattgggtttgggagtcccaaccaggacacagcatggacatgagggtccctgctcagctcctggggctcctgctgctctggctctcaggtgccagatgtgtcatccagatgacccagtctccatcccntcctgtctnactantactagtaggacgacnaactactaccacctactctacgtcggccggacgtacgtacgacgactatanatatagtatgtagtagtagtacacgacgaaccgaaaccggacggacgacccgtaaccctcaaactacctcgtacgtacctcgactacgtcctacgtttaccccgaaaccggtttacggggtaaaccctacgggtacccgtaaacgtttaccgtaagggtttacggaaacgggaacgggtacgnttacggggttacggtntaacggggtaaaccggttaaacggtttttaaaccttttttaaccccgttaaccccgtaacccgtaaccgaaaccggtaaccgggtaccgggtaccgggtacccggtaccggtaacccgtaacccggggttccgtaaacgggtaaacccgtaaaccgttttaacggtttacccggaaaaccccgtaaaaccttaaaacgttttaaaaccctttaaaccggtttaccggntttaaacggttaacggttaaaccggtttaacccggtttcccgaaccccgggttccccgtttaccccggtaaccccggttaaacccgggtacccggggggtttaaccccgggttaaaacggggttaacggggttaaacggtaacg

SEQ ID NO: 365328 - DNA, 493 bp, Homo sapiens
  misc_feature: GZ8MTXP01CVE8E.51.67.G01.1.454.CMB.2.raw
  modified_base (470)..(470): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacacgcccctaaactcctgactcctcgatgcatccactttggaaacaggggtccatcaggttcagtgaaagtggctcgtgggactagtatttacttcaccatcagcaggctgcagcctgaagcattgacaacattattactagtacaaacagtatagattagtctcccgctcgtacgtttcggggcgggggacaagggtgagncgtaagcgaatgtggctgctaac

SEQ ID NO: 365329 - DNA, 549 bp, Homo sapiens
  misc_feature: GZ8MTXP01EPHDJ.51.67.G01.1.454.CMB.2.raw
  modified_base (218)..(218): a, c, t, g, unknown or other
  modified_base (428)..(428): a, c, t, g, unknown or other
  modified_base (437)..(437): a, c, t, g, unknown or other
  modified_base (452)..(452): a, c, t, g, unknown or other
  modified_base (479)..(479): a, c, t, g, unknown or other
  modified_base (536)..(536): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggngagtcgagacattagcatgtatctagaattggtatcaagaaccaaaaaaccgagggaaccacgacccctaaactcctgactcctcgatgactattacctacgtttacggaaacgtacggggtacccaagtacgtaaaggttcaggtaggaaagtggcgtcgtagggactagttacttttacttcacctatcagcaggctgcagctagaanactagttanacaatattaattacngtacaatagtatagatacgtctcccgntcgtacggtttcggggacgggggttacaaggggtgagcgttacgaagacgaagttgnggctcgcgtaacc

SEQ ID NO: 365330 - DNA, 523 bp, Homo sapiens
  misc_feature: GZ8MTXP01BOBHK.51.67.G01.1.454.CMB.2.raw
  modified_base (459)..(459): a, c, t, g, unknown or other
  modified_base (493)..(493): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccgagggacacgaccccctaaactcctgactcctcgatgcatccactttaggaaacaggggtcccatcaaggttcagtggaaagtggctcgtggggactagtacttttactttcaacctatcagcaggctggacagcctagaagacattagacaactattaacttactgtacaactagttatagatacgtctcccgntcgtaacggtttcgggacgggggacagggtgagnttacgaagcgtaacgtggtgctgcgtaacc

SEQ ID NO: 365331 - DNA, 567 bp, Homo sapiens
  misc_feature: GZ8MTXP01ALCW1.51.67.G01.1.454.CMB.2.raw
  modified_base (217)..(217): a, c, t, g, unknown or other
  modified_base (315)..(315): a, c, t, g, unknown or other
  modified_base (464)..(464): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaccagggacacgcccctaaactcctgactcctcgatgcactccactttaggaaacnggggtccatcaaggttcagtggaaagtggctcgtagggactaggtattttacttcaccatcagcaggctgctagcctagaagacattcgacaactattaacgttactacgtacaaacgtagttaagtagtactacgttcctaccccggnttaacccgtaacggttttccgggggacgggggttaacctaaaggggtcggaacgacgttacgaaagccggtaaacgttcgggtggcgtaacggccgtaacccg

SEQ ID NO: 365332 - DNA, 690 bp, Homo sapiens
  misc_feature: GZ8MTXP01CLYGI.51.67.G01.1.454.CMB.2.raw
  modified_base (191)..(191): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctatagganacagaatcacatcacttgccgggcagtcgagacattagcatgtatctgaattggtatcaagacaaaaaaccgagggacaacgacccctaaacgtcctagactcctacgaattcgactatacctaacgttttacgggaaaaaccgtacgggggttaccccaaagttaccgtaaaggtttcgaaggttaggaaaacggttgggcttcgtaggggaactagtattttactttcaaccctatacaagcacgggctggaccaggccctaggaaagttacatttacgacaaccgtaacttaatttaaccttagttaccgaaacgtaagtaagttagtataaacggttacccttccccggtcccttaaccgttaaccggtttaccggggttaccggggggttaaccccgggaaacgggtttaacggggttaacgggttaacgttaagtaaacggtaacggaacccgttaacggtttagggccgtttaacggttaaccgtaaccccg

SEQ ID NO: 365333 - DNA, 504 bp, Homo sapiens
  misc_feature: GZ8MTXP01ENURB.51.67.G01.1.454.CMB.2.raw
  modified_base (192)..(192): a, c, t, g, unknown or other
  modified_base (396)..(396): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcagtcgagacattagcatgtatctgaattggtatcagacaaaaaccagggacagcccctaaactcctgatcctcgatgcatccactttggaacaggggtcccatcaggtcagtggaaacgtggctcgtgggactagtattttacttcaccatcagcaggctgacagcctagaagacattnacaacatattactatacaacagtatagtatagtactccgcctctcgttcgggtcgggggaccggaaggtaggagagttacgaagacgaacgtagtggcgtcgcgaacc

SEQ ID NO: 365334 - DNA, 795 bp, Homo sapiens
  misc_feature: GZ8MTXP01B5Q76.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccagggacacgaccccctaaactccctagactcctacgatgcctaataccctaacgtttacggaaacgtacgggggtaccccaagttaccgtaaagggttccaagggtaggggtaaaaggttcgggccgttaccggtaggggtaacttaacgggtttaacttttttaacctttacccaacctacttacgacggtacgaacggggtccttacggaccgtaacggtaccccgtaaggggaaaccgtaaccgtaagtttacgaaaccctaaaacgttaattttaaacgttttaaaccttacgggttaaacccaaaacttaagggttaactttaagggttaactttaaaccggttaccctttcccccgggtacctttaaccccggttaaccgggggtttttacccgggggggaacccggggggggttaaacccgtaaacggggggttacggggaaaggttaacggttaaccggtaaacgggccggtaaaaccggtttggggcgggttaccccggtaagggttaacccttaaccccgg

SEQ ID NO: 365335 - DNA, 575 bp, Homo sapiens
  misc_feature: GZ8MTXP01DARR5.51.67.G01.1.454.CMB.2.raw
  modified_base (430)..(430): a, c, t, g, unknown or other
  modified_base (454)..(454): a, c, t, g, unknown or other
  modified_base (468)..(468): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagctatgtatctagaattggtatacaagacaaaaaccgagggacacgacccctaaactcctagactcctagatgcctactcctacgtttaggaaaccgtggggtaccccaagtacgaaaggttcgaaggtggaaaagtggctcgtagggactagtacttttacttacacctatcagcaggctagacacgcctaggaactanattacacctaaagtattattaacngtacaaatgtatanattacgtcctcccgtctaacgtacggtttcggggacgggggttaaccaaaggggtcggaagcgttaacgaacgggacgtaacgttggcggttaccgtgccgtaaccg

SEQ ID NO: 365336 - DNA, 650 bp, Homo sapiens
  misc_feature: GZ8MTXP01C3DGN.51.67.G01.1.454.CMB.2.raw
  modified_base (216)..(216): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttggccggngagtcgagactattagctatgtatctagaattggtatacaagaacaaaaaccgaggacacgacccctaaactcctagactcctacgatcgctactccgtacgtttaggaaaccgtacggggtccccaagttaccgtaaaggtttacgaggtagggaaaacggttcgggtcgttacgtaggggtaaactacggtttaactttttaccctttacaaaccctattcgaaggcgacgggtctacggactacgtccgtaagaacgtactagtagaacctaaagtacttaacgtttaacacgttaacaaaccgtagtacttagattacggtccctcccgtactccggttacgggttacgggggaccgggggttaactaaaggggtgaacgttcgttaccggaagtaccgggtaattcggaggttccttaacgccgtaacg

SEQ ID NO: 365337 - DNA, 761 bp, Homo sapiens
  misc_feature: GZ8MTXP01CABO9.51.67.G01.1.454.CMB.2.raw
  modified_base (192)..(192): a, c, t, g, unknown or other
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggngagtcgagacattagcatgtatctagaattggtatcaagacaaaaaccagggacacgacccctaaactcctagactccctagatcgctatcctaacgtttagggaaaaccgtcgggggtacccccaagttaccgaaagggttttccgaagggttaggggtaaaaacggttcggggtccttaccggttagggggtaaacccttaagggtttaactttttttaacccttttacaaacccttacgttaccaaggaccgtaaggggccttcgggacctaacgggaccccgttaagggaaacgtaaaccgtatttaccggaactaaaccgttaaagtttaaacgttttaaccttagtttaaaccaaacgtaacggttaattaggtaacttaaacggttacccttcccccggtacctttccggtaaaccgggtttttcccggggggacccggggggggttaaacccgtaaagggggttacgggaaggttacgttacggtaaacggaccggtaaaccgttgggtacgggttctaacgggaaccgtaacccg

SEQ ID NO: 365338 - DNA, 633 bp, Homo sapiens
  misc_feature: GZ8MTXP01CO3H9.51.67.G01.1.454.CMB.2.raw
  modified_base (192)..(192): a, c, t, g, unknown or other
  modified_base (292)..(292): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgaattggtatcagacaaaaaccagggacacgcccctaaactcctagatccncgatgctatccactttaggaaacgacggggtccatcgaaggttcagtggaaagtgctcgtagggactagtattttactttcacctatcagcgtaggcctgactacgcctagaaacgtactaattgaccaaacgtatttaactttaacctagttaccaaacgtaggttaaatacggtaattaacggtcccttccccggtcgttcccgtaaccgggttttcccgggggaccgggggggttaaacccgtaaacgggggttcggaaagggttacgttaacccggaaacgggtacccggtaaaacgttggggtttacgggcccgtttaacggaacccgttaacccg

SEQ ID NO: 365339 - DNA, 520 bp, Homo sapiens
  misc_feature: GZ8MTXP01EOWZU.51.67.G01.1.454.CMB.2.raw
  modified_base (187)..(187): a, c, t, g, unknown or other
  modified_base (425)..(425): a, c, t, g, unknown or other
  modified_base (435)..(435): a, c, t, g, unknown or other
  modified_base (462)..(462): a, c, t, g, unknown or other
  modified_base (499)..(499): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctanaggagacagaatcaccatcacttgccgggcagtcgagacattagcatgtatctgaattggtatcagacaaaaccagggacacgcccctaaactcctgactcctcgatgctattccaacgtttaggaaacgtacgggggtcccaagtcgaaaggtttcgaggtggaaagtggcttcgtggggactagtatttttacttcacctatcagcaggctgacagcctagaagacattgacaacnttaattaccngtacaactgtatgactacgtctcccgntcgtacgtttcggggacggggttacagggtcgagttncgaagcgaactgagctgcaac

SEQ ID NO: 365340 - DNA, 608 bp, Homo sapiens
  misc_feature: GZ8MTXP01EART3.51.67.G01.1.454.CMB.2.raw
  modified_base (193)..(193): a, c, t, g, unknown or other
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctatagganacagaatcacatcacttggccggnagtcgagacattagcatgtatctgaattggtatcaagaacgaaaaaccgaggaccacgacccctaaactcctgactcctacgatcgacctactacctacgttttaacggaaacgtacgggggtacccctaagttaccgtaaagggtttcgagggtaggtaaaagggttcggtcgttcgtaggggtaacctaagttactttttacttacaccctatacagcgaggtcctgacgagacctagaaacactattacgaactaagtaattactttaactacgtacaaataggtataagactacgttcctacccgtcgtaacgtacgggttcggggacgggggttacgaaagggtcgaaagttcgttacgaaggtacgaagttggcggctcgctaac

SEQ ID NO: 365341 - DNA, 701 bp, Homo sapiens
  misc_feature: GZ8MTXP01C732J.51.67.G01.1.454.CMB.2.raw
  modified_base (218)..(218): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacgttggccgggngagtcgagacattagcatgtatctgaattggtatacaagacaaaaaccgagggacacgacccctaaactcctgactcctgatcgctactccgtacgtttaggaaaccgtcggggtaccctaagtacgtaaagggttcagggtaggaaagtcgggtctcgtaggggaacttaagttacttttacttacaaccctataccgagccgagggcttacggactacgaccgtaggaaacgtactaagtttcgaaacctaaacgttaacttaacgtttaacctaacggttaacctaaaacgtaggttaaagttagggtaaacttaccgggtttaccctccccggttacgttaacccggttaaaccgggtttccggggggaaaccgggggttaaacccgtaaagggggtcggttaaacggttacaacccggtaaaaggtcccggtaaggtttaacggggccggttaccgttaacggaacccggttaacccg

SEQ ID NO: 365342 - DNA, 551 bp, Homo sapiens
  misc_feature: GZ8MTXP01ATFW1.51.67.G01.1.454.CMB.2.raw
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcaagacaaaaaccgagggacacgacccctaaactcctagactcctcgatgcactccagtttacggaaactagggtccatcaaggtcagtggaaagtgctcgtgggacagtattttactcactatcagcaggctgcagcctagaagactagttacgacaaacgtattaacttactacgtaaccaaagtagtatagtacttacgtccctcccgtcgtaaccgtacggtttccgggggacgggggaaccgtaaaggggtggaagacttacgaagcggaacgtggtcggactcgaaccgtaacg

SEQ ID NO: 365343 - DNA, 577 bp, Homo sapiens
  misc_feature: GZ8MTXP01DTIUG.51.67.G01.1.454.CMB.2.raw
  modified_base (495)..(495): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccagggacacgacccctaaactcctgactcctcgatcgcatcctacgtttacggaaacgtacgggggtaccccagtacgtaaaggtttcaaggtaggaaaagttgggcgtcgtaggggaactagttacttttactttcacctatcaagcgaggctgacagccgtagaacgactattacactaaactatttaacttactagtaccaaatagttatagaattcgtacctccccgnttaaccgtacggtttcgggggacgggggaaccgtaaaggggtggagattacgaagtcggaacgttggcggttctcgctaacc

SEQ ID NO: 365344 - DNA, 560 bp, Homo sapiens
  misc_feature: GZ8MTXP01BGC8V.51.67.G01.1.454.CMB.2.raw
  modified_base (217)..(217): a, c, t, g, unknown or other
  modified_base (486)..(486): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgaattggtatcaagacaaaaaccgagggaccacgacccctaaactcctgactcctcgattcgactatccgaacttttagggaaaccacgggggtacccccaagttaccgtaaaggtttcgaaggtggaaaagtcggctcgtggggacctaggttacttttacttcacccatacagcaggctgcagcctagaagacattagacaaacgtattatactagtacaaactagtatagatacgtctcccgntccgtagttcggggacggggttacaaagggtggacgttgttacgaagcgtaacgtcggtaggcctgcctaaccg

SEQ ID NO: 365345 - DNA, 755 bp, Homo sapiens
  misc_feature: GZ8MTXP01A4LNJ.51.67.G01.1.454.CMB.2.raw
  modified_base (218)..(218): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttgccgggngagtcgagacattagcatgtatctgaattggtatcaagacaaaacgagggacacgacccctaaactcctgactcctacgatcgactactacctaacgtttacgggaaacgtacgggggtaccctaacgttacgtaaagggttaccgtaagggttagggtaaaacgggttcgggtccgttacgggtacgggggtaaacccttaaggtttaacttttttacctttacaaccctagttacccgaaggtccgaacgggtccttaggacccgacgtacccgttaggaaacggtaaccgtaatttacggaaccctaaacgtaaagtttaacgtttaaaccgtacgttaaccgtaaaacctaggttaacttaagggtaactttaacggttcccccttaccccggttaccgttaacccggttaaccccgggttttaggggggaacccgggggttaaaccgtaaagggggttaccgggaaggttacgttaccggtaaacggccggtaaaccgttgggtaccggttccgttccggaacgttaacccg

SEQ ID NO: 365346 - DNA, 738 bp, Homo sapiens
  misc_feature: GZ8MTXP01DD11T.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctagaattggtatcaagaacaaaaaaccgagggaacacgacccctaaactccctgactcctacgatgcaatcctaacgtttaggaaaaccgtacggggtaccccaagtaccgtaaaggtttcaaggttaggaaaagtgggtaactcgtaggggaaacttaggttaacttttttaactttccaaccctattaccagaccgaggccttggaccacggcccttaacggaaagtaccgtaagtttacgaacccaaacgtaaacttaaagtttaacccgtttaagttaacccgtaaacgtaaacgttaaagttaacgttaattaaaccggttacccttaccccggtcccgttaaccgttaacccgggtttacccgggggttaacccggggggttaaaccccggggtaaacggggtaacggggttaacgggttaagttaaccgtaaaccgggaaggtaacccggttaacgggttagggttcgtaaccgggttaaccgtaaaccccg

SEQ ID NO: 365347 - DNA, 746 bp, Homo sapiens
  misc_feature: GZ8MTXP01ERW1K.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccagggaacacgacccctaaactcctagactcctcgatgcaactcctaacgtttacggaaacgtacgggggtacccctaagtaccgtaaaggtttccgaaggttaggggtaaaaaggttcgggtccgttaccgtacgggggtaacccttaaagggtttaacttttttaaccctttacctaaacccctaatttaccgaaacggtaccgaacggggtccttacggtaccgaacgggtaccccgttaaggaaaacggtaaccgtaatttaacggaacctaaaaccgtaatttaaacgtttaaaccttacggttaaaccaaaaccgtaaggtttaacttaacgggtaattaaccgggttaccccttaccccggtccgttaaccggtaaccggttttaccggggggaccggggggttaaacccgtaaggggttaggaacgacgttaaccgaaggtacgtaacgttggtcgggcttcggaaccgtaaccg

SEQ ID NO: 365348 - DNA, 554 bp, Homo sapiens
  misc_feature: GZ8MTXP01EP9LJ.51.67.G01.1.454.CMB.2.raw
  modified_base (215)..(215): a, c, t, g, unknown or other
  modified_base (521)..(521): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagatcaccatcacttgccggngagtcgagacattagcatgtatctgaatggtatcaagacaaaacgaggacacgacccctaaactcctgatcctcgatgcatccgtacgtttaggaaaccgacggggtaccccaagtacgtaaaggttcgaggtggaaaagtcggcgtcgtgggactaagtatttttactcgaccatcgagcgaggctgacgacgccgtagaagactattacgactaaacgtattattaacctagtacaacgtagtatagatacgtcctccggctaacgtcgtttccggggacgggggttacgaagggtcggaacgnttacgaagtcgaacgtggtacgctcgctaaccg

SEQ ID NO: 365349 - DNA, 681 bp, Homo sapiens
  misc_feature: GZ8MTXP01E4HCU.51.67.G01.1.454.CMB.2.raw
  modified_base (216)..(216): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggngagtcgagacattagcatgtatctgaattggtatcaagacaaaaccgaggacacgacccctaaactcctagactcctacgactgacactacccgtaactttacgggaaaccgtacgggggtacccctaacgtaccgtaaaggtttacgaaggtagggaaaacggttcgggcgttacggtaggggtaactaggttaactttttaactttacaacctactaccgaaggcgaaggccttagaccacgggtaccctaaggaaacgtaacctaagttacgaaacctaaacgtaatttaaactttaaaccgtagtaaacctaaactaacggttaattacggtaacttacgggttaccctccccgtcgttaaccgttaccgggtttaccgggggaccggggggttaaccgtaaaggggtggaaggttacgttacgaaggacgtaacgtcggtggacctcggaaccgtaaccg

SEQ ID NO: 365350 - DNA, 828 bp, Homo sapiens
  misc_feature: GZ8MTXP01AI8R4.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctgaattggtatcaagaccaaaaccagggaccacgaccccctaaactcctgactcctcgatcgacctacttaccctaacgtttacgggaaaccgtacgggggtacccctaacttaccgtaaaggggtttccgaagggttaggggtaaaacgggttcggggtccgttacgggttacgggggtaaaccttaacgggtttaactttttttaaccctttaccgtaaaccccctacgtttacccgtaaacgggaccgtaacggggtcccttacggtacccgaacgggtaccccgttaagggaaaacggtaacccttagtttaacggaacctaaacgtttaaactttaaacttttaaccgttacggttaaaccctaaaacgtaggtttaaagttaacggttaaactttaaccgggttacccccttccccggttaccgttaacccggtttaacccggggttttacccggggggggaacccggggggttaaaccccggtaaagggggtcggggttaaacggacgtttaaccccgggaaagggtacccggtaaacgggttcggggtacgggttacgttaaccggaaccgtaaccccg

SEQ ID NO: 365351 - DNA, 568 bp, Homo sapiens
  misc_feature: GZ8MTXP01DVQZX.51.67.G01.1.454.CMB.2.raw
  modified_base (535)..(535): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctgaattggtatcaagacaaaaccagggacacgacccctaaactcctgactcctcgatcgctatcctacgtttacggaaacgacgggggtaccccaagttaccgtaaagggtttccgaaggttaggaaaggtggcgtcgtaggggaactagtattttacttcaccatcagcacggctgacgacgcctagaagactattacgactaactaattactttaactagtacaaacgtagttatagtatacgtcctcccgtctcgtacggttcggggacgggggttacaaagggtcgaagnttcgaagtacgaacgtggtcggctcgctaaccg

SEQ ID NO: 365352 - DNA, 808 bp, Homo sapiens
  misc_feature: GZ8MTXP01BOLSM.51.67.G01.1.454.CMB.2.raw
  modified_base (193)..(193): a, c, t, g, unknown or other
  modified_base (218)..(218): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctatagganacagaatcaccatcacttgccgggngagtcgagacattagcatgtatctgaattggtatcaagacaaaaaccgagggacacgacccctaaactcctagactcctacgatcgacctactcctaacgttttacgggaaaaccgtacgggggttacccctaagttaccgtaaaggggtttaccgaagggttaggtaaaagggttcgggccgttaccggtagggggtaacctaaaggtttaacttttttaaccgtttacaaaccctattaccaaggtaccgaggggtcccttaggacccgaacggtcccttaagggaaacggaacctaagtttaacgaacctaaaaccgttaatttaaacgtttaacccttaaggttaaaccgtaaaacctaaggtttaaacttaaggtaacgtttaacccgggttaccccttcccccggttaccgtttaacccgggtttaacccgggtttttacccgggggggggaaaccccggggggggttaaacccgtaaaggggggttaccgggaaagggttaacgttaacccggtaaaacgggaaccggttaaacccggtttggggacccggggttccttaaccgggttaaccccgtaaccccg

SEQ ID NO: 365353 - DNA, 647 bp, Homo sapiens
  misc_feature: GZ8MTXP01CYEDO.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctcctgtctgcatctataggagacagaatcaccatcacgttggccgggcgagtcgagacattagcatgtatctagattggtatcaagacaaaacagggacacgacccctaaactcctgactcctgatgacctactccgtacgtttaggaaaccgtacgggggtacccaacgtacgtaaaggtttcgaaggttggggaaaacggttcgggcgttacggtacggggtaactaaggtttacttttactttacaaccctatccgaagcgaggctgactacgacctagaacgactattacgaactaaacgtactttaatttaacctaggttacaaacgtagttattacggtacttaccgtcccgtcccgtcgttaacccggttaccgggtttacgggggaccggggggaaaccgtaaaggggtggaagttacgttacggaaacggcggttaaccgtgggtcggactcggaaccgttaacccg

SEQ ID NO: 365354 - DNA, 699 bp, Homo sapiens
  misc_feature: GZ8MTXP01C6VR0.51.67.G01.1.454.CMB.2.raw
  modified_base (215)..(215): a, c, t, g, unknown or other
  modified_base (263)..(263): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctcctgtctgcatctataggagacagaatcacatcactgccgggngagtcgagacattagcatgtatctgaattggtatcaagacaaaaccgnggacacgacccctaaactcctgactcctcgatcgctactccgtacgtttacgggaaaccgtacgggggtacccctaagtaccgtaaagggttccgtaaggggttaccgggaaaagggttcgggtcccgttacgtacgggggtaaaccttaacgggtttaactttttaacccttaccaaaccctacttaccgacggaccgtaaggtccgttcggacctacggtaccccttagaaacgtactagttagaaccctaagtaacttaattaacctacggtaactaaacgtagttaatagtaattaccggttcccgtccccgtacgtttcccgtaaccgggttttccgggggaaaccgggggttaacccgtaagggtacgggaacggttacttacggaaacgtcggtaacgttcggtacgggttctaaccggccttaacccg

SEQ ID NO: 365355 - DNA, 647 bp, Homo sapiens
  misc_feature: GZ8MTXP01DEMCB.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttgccgggcgagtcgagacattagcatgtatctgaattaggtatcaagaacaaaaaccgagggaacacgacccctaaactcctgactcctcgatcgctactcctaacgtttacggaaacgtacggggtaccctaagtacgtaaggttcgaggtagggaaagttggcgtcgtaggggaaccttaaggttacttttacgtttacaacctattcgagtcgacggtcttagaccacggtcctaagaacgtaactagttacgacctaaacgtaactttaactttacgtacgtaactaacgtagttagttaacgtacgttaccgttaccctcccgtacgttccggttaacggtttccgggggaaccgggggttaacgtaagggtcgggaaacgttgaccgtaaacgtacgtaacgttcggacgttcgttaacgaaccgtaaccg

SEQ ID NO: 365356 - DNA, 709 bp, Homo sapiens
  misc_feature: GZ8MTXP01D96SL.51.67.G01.1.454.CMB.2.raw
  modified_base (193)..(193): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctatagganacagaatcaccatcacgttgccgggcgagtcgagacattagcatgtatctagaattggtatacaagaacaaaaaccgaggaacacgacccctaaactcctagactcctacgatgctactacctaacgtttacggaaacgacggggtaccccaagtaccgtaaaggttcaaggtaggtaaaacggtcgtcgtacgtaggggactaagttaactttttacttcaaaccctattcgaagccgaagggtcctaggaccgacgtacccgtaaggaaacgtaacctaagtttacgaacccttaaacgtaaatttaacgtttaaaccttacggttaaaccaaaacttaaggttaacttaaggtactttaaaccggtaccccttccccggtacgttaaccggttacccgggtttaccggggggaaccggggggttaaacctaaagggggttccgggttaaacgagttaacccggtaaaggacgggtaacctgggttaccgggacttccggaaccgttaaacccg

SEQ ID NO: 365357 - DNA, 627 bp, Homo sapiens
  misc_feature: GZ8MTXP01BSU0C.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatcacatcacgttgccgggcgagtcgagacattagcatgtatctagattggtatacaagacaaaaaccgaggacacgacccctaaactcctagactcctacgatcgacctacttacctacgtttacggaaaaccgtacgggggtacccctagttacgtaaacgggtttcgaggtagggtaaaagggttcgggtccgtcgtacgggggtaaacttaggtttaacttttttacctttaccaaccctattaccgaggacgaacgggtcctcggtacgaacggtccctaaggaaacgtactagttacgaactaacgtattactactagtaccaatagtatagacttacgtctcccgtctcgtcggttacggggcggggaccgtaaagggtcggagcgttacgaaggtcgaacgttggacggctcgccgtaacc

SEQ ID NO: 365358 - DNA, 667 bp, Homo sapiens
  misc_feature: GZ8MTXP01EL4X2.51.67.G01.1.454.CMB.2.raw
  modified_base (192)..(192): a, c, t, g, unknown or other
  modified_base (219)..(219): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacgttggccgggngagtcgagacattagcatgtatctagaattggtatacaacgaacaaaaaccgagggacacgacccctaaacgtcctagactcctacgatcgacctaacttccgtaacgtttacgggaaaccgtacgggggtacccctaagttacggtaaaggttcgaaggtaggaaacggttcggtcgtacgtacggggaactaggttaactttttacctactaacctacttacgaacgcgacggtccttacggacgacgttccctaagggaaacgtacgtaattacgaactaaacgttaattaacttaactacgtaacaaacgtagttagtaggtacttaaccgtccgtcccgtgtaaccggtaccggtttcgggggaccgggggttaaacgtaacggggttgaacgttcgttaacgaacggtacgtaacgttggacggcctaacggttcctaaccg

SEQ ID NO: 365359 - DNA, 753 bp, Homo sapiens
  misc_feature: GZ8MTXP01BI50D.51.67.G01.1.454.CMB.2.raw
  modified_base (193)..(193): a, c, t, g, unknown or other
  modified_base (219)..(219): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctatagganacagaatcaccatcacgttggccggngagtcgagactattagctatgtatctgaattggtatacaagaacaaaaccgaggacacgacccctaaactcctgactcctacgatcgacactcctacgtttacggaaacgtacgggggtaccccagtacgtaaggtttacgaggttagggaaaaggtcggcgttacggtaggggtaacctaagtttacttttttaaccttacctaacctaacttccgaaacggtccgaaacggggtccttacgggtacccgaacggtacccgttaagggtaaaacggaacctaaaggtttacgaaacccgtaaaaccgttaagtttaaacgttttaaccctaaggttaaaccctaaaacgtaaggtttaacttaagggtaacttaaacccgttacccgttcccccgtacggttaacccgttaaccgggggtttccggggggaacccggggggttaaacccgtaaacggggtagggttaacgttacggttaccgaaacggtacggtaaccgttgggtaccggttcgttcggaacccgttaacccg

SEQ ID NO: 365360 - DNA, 572 bp, Homo sapiens
  misc_feature: GZ8MTXP01DG1N6.51.67.G01.1.454.CMB.2.raw
  modified_base (192)..(192): a, c, t, g, unknown or other
  modified_base (215)..(215): a, c, t, g, unknown or other
  modified_base (539)..(539): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcacatcactggccggngagtcgagactattagctatgtatctagaattggtatacaacgaacaaaaaccgagggaacaccgacccctaaactcctagactcctcgatcgctaactacctacgtttaggaaaccgtcggggtacccaagtacgtaaggttcgaggtaggaaacggtgtcgtcgtagggactagttacttttacttcaacctatcagcgaggctgacagcctagaacactattcgaactaactattaattactacgtactaaagtgtaatagacttacgtcctccgtcgtcgtacgggttcggggacgggggttacgtaagggtgttaacgngttacgaagacgtaacgtggacggctcgctaac

SEQ ID NO: 365361 - DNA, 600 bp, Homo sapiens
  misc_feature: GZ8MTXP01DLSQZ.51.67.G01.1.454.CMB.2.raw
  modified_base (192)..(192): a, c, t, g, unknown or other
  modified_base (448)..(448): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttggccgggcgagtcgagactattagcatgtatctagaattggtatcaagaacaaaaccgagggacacgaccccctaaactcctagactccgtgatgctatacctagtttacggaaacgtcgggtacccagtacgaaggttcgaggtggtaaagtggtctcgtagggtaactagttacttttacttacaccatcgagcgaggtctacgacacgtctaggaacactatacgaacaaacgtnttaacttacgtacgtaacctaaagtagttaatagtacttacgttccctcccggtcttaacggtaaccgggtttcgggggaaccgggggaaaccgtaaggggttgaagacgttaccgaaggacccgtaagtgggcgttactcgaacctaaccg

SEQ ID NO: 365362 - DNA, 572 bp, Homo sapiens
  misc_feature: GZ8MTXP01AR85Y.51.67.G01.1.454.CMB.2.raw
  modified_base (218)..(218): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttgccgggngagtcgagacattagcatgtatctgaattggtatcaagacaaaaaccgaggacacgacccctaaactcctcgatcctcgatcgctactccactttaggaaacgtacggggtccacgtcaaggttcgagtaggaaagtgggctcgtaggggaactagtacttttactttcaaccattcaagcaggtctgcagcctagaagacattgacaacgtatattacctgtactaacgagtatagtactacgtcctcccgtacttcgtaccggtttccggggacgggggttaaacccgtaaggggttcggacgttagacccggaaggtacgaaacgttgcgggttctaacggaacgtaaccc

SEQ ID NO: 365363 - DNA, 639 bp, Homo sapiens
  misc_feature: GZ8MTXP01C68RC.51.67.G01.1.454.CMB.2.raw
  modified_base (191)..(191): a, c, t, g, unknown or other
  modified_base (214)..(214): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcactgccggnagtcgagactattagctatgtatctagaattggtatacaagaacaaaaaccgaggacacgacccctaaactcctgactcctacgatcgactatcctaagtttaggaaaccgtcggggtacccctaagttccgtaaagggttcgaaggtagggaaaaggttcggtcgttacggtagggtaaacttagttaactttttaccttacaactatacgaagccgtaaggcctggactacgtaccgtagaacgtactagttacgaactaacgttaagttaacttaacgtagtaacaaactagtaagtagtacttacgtcctcccgtcgttaaccggtacgggtttccgggggaccgggggaaccgtaaaggggtggttaaacgttgttaacgaacggtcgtaaccgtggtcgggttacctcggccgtaaccg

SEQ ID NO: 365364 - DNA, 582 bp, Homo sapiens
  misc_feature: GZ8MTXP01DVNR0.51.67.G01.1.454.CMB.2.raw
  modified_base (215)..(215): a, c, t, g, unknown or other
  modified_base (262)..(262): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgccggngagtcgagacattagcatgtatctgaattggtatcaagacaaaaacngggacacgacccctaaactcctgactcctacgatgcctatacctacgtttaggaaacgtcgggggtacccatcgtaaaggttcaggtggaaagtggctgtgggactagtacttttacttcacctatcaagcgaggctgaccaggtccctaggaaactactaagttacgaacctaaacctaattaatttaccgtagtaccaaacgtagttatagtactacggtcttccccgctcgtaccggtttcggggaccgggggaccgtaagggttggaagttacttacgaagtacggtaacgttgggtacggcttcggcgtaacccg

SEQ ID NO: 365365 - DNA, 595 bp, Homo sapiens
  misc_feature: GZ8MTXP01D52JT.51.67.G01.1.454.CMB.2.raw
  modified_base (192)..(192): a, c, t, g, unknown or other
  modified_base (218)..(218): a, c, t, g, unknown or other
  modified_base (322)..(322): a, c, t, g, unknown or other
  modified_base (549)..(549): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttggccgggnagtcgagacattagcatgtatctgaattggtatcaagacgaaaaaccgagggacacgaccccctaaactcctagactcctcgatcgcatccatttaggaaacgngggtcccatcaaggttcaggtaggaaagtgggctcgtagggactagttacttttacttacaacctatcgagcgaggcctggactacgacctaggaacgtacattacgaccctaaagtatttaactttactaagtacctaaagtattaataggtacttaccggtcctcccgcttaaccggtacgggtttccgggggaccggggggaactaaaggggtcgttaacgggnttaacggaaacggcgtaaccgtgggtcggttactcggcctaacccg

SEQ ID NO: 365366 - DNA, 622 bp, Homo sapiens
  misc_feature: GZ8MTXP01DWEAC.51.67.G01.1.454.CMB.2.raw
  modified_base (191)..(191): a, c, t, g, unknown or other
  modified_base (242)..(242): a, c, t, g, unknown or other
  modified_base (312)..(312): a, c, t, g, unknown or other
  modified_base (505)..(505): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatcgacccagtcctccatccctccctgtctgctatctanaggagacagaatcaccatcacgttggccgggcgagtcgaagactattacgntatgtatcgtagtaatggtatacgaagaaaccaaaaccggaggaaccaccgaaccccctaaactccgtanactccctgactcgactactaccgtagttacggaaacgtcggtacccagtacggtaagttcgaggtggaaacgtggtcgtcgtagggtacttacgtttactttactactactatacgacggctaggccgtagccgtacgacgtaagaactactatacaacctaagttattacgttacataactaatagtattanaccgtaccgtccctccgtcttaacccggtaacgggttccgggggaacgggttaaccggtaagggtagaacggttacttaacgaagggtacgtaacgtggcgaccgtcgaacgtaacg

SEQ ID NO: 365367 - DNA, 671 bp, Homo sapiens
  misc_feature: GZ8MTXP01ADDK1.51.67.G01.1.454.CMB.2.raw
  modified_base (218)..(218): a, c, t, g, unknown or other
  modified_base (267)..(267): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacgttggccggngagtcgagacattagcatgtatctgaattggtatcagaacaaaaaccgngggacacgaccccctaaactcctagactcctacgatcgactactcccgtacgttttacggaaaacgtcgggggtacccctagtaccgtaaggtttacaagggtggtaaaacgtcgggccttacggtaggggtaactaggttactttttactctaccctattacgagcgagggtctagacctagccgtagaacgactattacgacctaaagtagttaacgtttaccgtaggtaaaccctaaagtaagttagttagtacgttaaccgttacccgtccccgtacttaaccggtaccggggttttaccggggaccgggggttaaaccgtaacggggttaggaacgttacgttacgaaacgggtaccgtaaaccggtttgggcggttacgtccggttaaccttaacccg

SEQ ID NO: 365368 - DNA, 583 bp, Homo sapiens
  misc_feature: GZ8MTXP01DTFLZ.51.67.G01.1.454.CMB.2.raw
  modified_base (220)..(220): a, c, t, g, unknown or other
  modified_base (510)..(510): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacgttggccgggngagtcgagactattagcatgtatctagaattggatcaagaaccaaaacgaggaccacgacccctaaactctgactacctcgactcgactactccgtacgtttacggaaacgtcggggtacccagtacgtaaggttcgaggtaggaaacgttcggtcgtcgtagggtaactagttacttttacttcacctatcgaagcgaggtctcggacacgtacctagaacgctaagttacaacctaagtaattacgttactacgtaacaaatggtatacgtatacctccgtacccgtntaacggttcgggttcggggacggggttacgtaagggtgagcttacgaagcgtaacgtgcggttctcgctaacg

SEQ ID NO: 365369 - DNA, 619 bp, Homo sapiens
  misc_feature: GZ8MTXP01A4ROY.51.67.G01.1.454.CMB.2.raw
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctagaattggtatcagacaaaaccgaggacacgacccctaaactcctgactcctcgatgcatcctacgtttagaaacgacggggtcccaagtacaaaggttcaggtggaaagtggctcgtagggacagttattttactcaccatcagcgaggtctgacagtacctagaaacgactaagttacgacctaaacgtacttaatttaaccgtagtaaccaaataggttaactaggtacttaacgttccgtaccccgtcgttaaccgttaacggtttccgggggacccgggggttaacccgtaaaggggttacgggaacgttaacggttacgaaacgggtccggtaaacgtttcgggcggttaccgttcggaacccgttaacccg

SEQ ID NO: 365370 - DNA, 654 bp, Homo sapiens
  misc_feature: GZ8MTXP01BT8JM.51.67.G01.1.454.CMB.2.raw
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagatcacatcacgttggccgggngagtcgagactattagcatgtatctagaattggatacaagacaaaaaccgagggaccacgacccctaaactcctgtactccgtagactcgacctactccgtaacgtttacggaaaacgtcggggtacccagtacgtaaaggttcgaagtcgggaaaagtcgggtcgtacggtacgggtacttacggttaacttttacgttaccaacctacttacgacgtacggaagggtctggaccccgtagtaccgttaggaactaactaagtttacgaaccctaaagttaactttaacgttaaccttacggtaactaaacgtagttaagtggtattaccgtcctcccgtagtccgtacgggttcgggggacggggttacgaaaggggttggaacgttcgttacggaagggtaccgtaaggtcgggtacgttctcggaacccgtcg

SEQ ID NO: 365371 - DNA, 792 bp, Homo sapiens
  misc_feature: GZ8MTXP01DKQNE.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctgaattggtatcaagacaaaaccgagggacacgacccctaaactcctagactcctcgatcgactaactccctaacgtttacggaaaccgtacgggggtaccccaagttaccgtaaagggttccaagggttagggtaaaacgggttcgggtccgttaccggtagggggtaaaccttaaggtttaacttttttaaccgttttaccaaaccctaagttaccgaaggtacccgaagggtccgttcggaccgtaacgtacccgttaaggaaaacggttacctaaagtttcgaaacctaaaacgttaacgtttaaacgttttaacctacggttaacctaaaaccgttaaggttaaacttagtaaacgtttaacccggttcccgttacccccgggttacttcccggtttaaacccgggggttttcccgggggggaaacccgggggggttaaacccgtaaacggggggtttacgggaaagggttaacgttaaccgggaagggtaacccggtaaacggttcgggttacggggttaccttaaccgggaacccgttaacccg

SEQ ID NO: 365372 - DNA, 801 bp, Homo sapiens
  misc_feature: GZ8MTXP01C7BU7.51.67.G01.1.454.CMB.2.raw
  modified_base (191)..(191): a, c, t, g, unknown or other
  modified_base (219)..(219): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctatagganacagaactcaccatcacgttggccgggngagtcgagacattagctatgtatctagaattggtatacaagaacgaaaaaccgcgggacacgacccctaaactcctgactcctagactcgacctagtacctaagtttacggaaaccgtcggggtaccccaagttaccggtaaggtttcgaagggttacgggtaaaacggttcgggtccgttacgggttacgggggtaaaccttaacgggtttaacctttttttaaccgtttaccgaaaccccgtaatttacccgaaaggtacccgaaagggttccgttacggggaacctaaggtaaacccgttaaggggtaaaaccaaacgtaatttaaccggaacctaaaacgttaaacttttaaacgtttaaaccttacggtaaacctaaaacgttaaggtttaaacttaaggggtaacctttaaacccgggtttccccttaccccgggtacgttttaaccccggtaaccggggttttacccggggggaaccggggggttaaaccgtaaacgggggttaggaaacgttacgttaaacccggaaggtaccggttaagtcgggtccggttacgttaaccgaaccgtaacccg

SEQ ID NO: 365373 - DNA, 677 bp, Homo sapiens
  misc_feature: GZ8MTXP01EXI6L.51.67.G01.1.454.CMB.2.raw
  modified_base (197)..(197): a, c, t, g, unknown or other
  modified_base (231)..(231): a, c, t, g, unknown or other
  modified_base (576)..(576): a, c, t, g, unknown or other
  modified_base (638)..(638): a, c, t, g, unknown or other
  modified_base (655)..(655): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatcgacccagtcctccatccctccctgtctgctatctagtagganaacaagaactcaaccatccacgttgggccggggnaaggtcgaagtactaattagctagtgtatctagaattggtatacgaacgaaacaaaaccgaggaccaaccgacccctaaactctagtactcctagtatcgacctaacttccgtaacgttacgggaaacgtaccggggttaccaacgttacggtaaacggtttgaacggggtaggtaaaaggttcgggtcgttacgggtaacggggaactttaaacggtttaactttttaacccttaccaaaccctagtacaacgggacgtagggtcccttagaccgtacgtccaaggaaacacttaagtacgactaaacgtaatttaacgtcttaaggaacctaagatttaacgngtactacgtccctccgtctcgggttacggttcgggggacgggttaacagggtacgaagttcncggtaaaggcgtaacgnggtacgcgtaacgttctaaccg

SEQ ID NO: 365374 - DNA, 632 bp, Homo sapiens
  misc_feature: GZ8MTXP01DIHC9.51.67.G01.1.454.CMB.2.raw
  modified_base (216)..(216): a, c, t, g, unknown or other
  modified_base (618)..(618): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctcctgtctgcatctataggagacagaatcacatcacttgccgggnagtcgagacattagcatgtatctgaattggtatcaagacaaaacgagggacacgaccccctaaactcctagactcctacgatcgacctaactcccgtaacgttttacggaaaaccgtacgggggtacccctaacgttaccgtaaagggtttccgtaagggtagggtaaaacgggttcgggtccgttacggtacgggggtaaacttaaggtttaactttttaacttttaccaaaccctacttacgacggtaccgagggccttggactacgacctagaacgtactattacgactaaacgtattattactacgtacaacgtagtatagtactacgttcctcccgtctaacgtccggtttcggggacggggacgtaagggtcgagcgttacgaagaccgaagtggnggactcgctaaccg

SEQ ID NO: 365375 - DNA, 653 bp, Homo sapiens
  misc_feature: GZ8MTXP01BX0XR.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacgttggccgggcgagtcgagacattagctatgtatctagaattggtatcaagacaaaacaggacacgacccctaaactcctagactcctacgatgacctactaccgtacgtttacgggaaacgtacgggggtaccctaacgttacgtaaggttcgaaggtggggtaaaagttcggcgtcgtagggtaacctaaggtttactttttaaccttacgtaaccctattacgaggacgacgggtctacggacgacgacctaggaaacgtacaagttagacctaaagtactttaactttaacctagttacaaacgtaggttaatacggtactacgttccctaccggtcttaaccgtaccgggtttcgggggaccgggggttacgtaaaggggttggaacgacgttacggaaacggcgtaaacggttgacgggttctaacggaacgtaacccg

SEQ ID NO: 365376 - DNA, 699 bp, Homo sapiens
  misc_feature: GZ8MTXP01BXAJ8.51.67.G01.1.454.CMB.2.raw
  modified_base (192)..(192): a, c, t, g, unknown or other
  modified_base (217)..(217): a, c, t, g, unknown or other
  modified_base (624)..(624): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggnagtcgagacattagctatgtatctagtaattggtatacaagaacaaaaaaccgagggaaccacgaccccctaaaactcctagactcctcgattcgacctactccgtaacgtttaggaaaaccgtacggggtacccctaattaccggtaaaggtttcgaagggtaggaaaacggttcgggtcgttcgtaggggtaacttacgttaattttttaccttacaaccctattccgaagcggaggtctagacacgtaccgtaggaaacgactaagttacgacctaaacgttaatttaacggtttaaccttacggtaaactaaactagttaacgtagtacgtaaccgttcccctaccccgtacgttaacccggtacgggtttcccggggggaacgggggacccgttaaaggggnggttaacgacgttacggaaacgggtacccggtaagtttcgggacgggttaccgttaaccgggcccgttaaacccg

SEQ ID NO: 365377 - DNA, 619 bp, Homo sapiens
  misc_feature: GZ8MTXP01BLAF4.51.67.G01.1.454.CMB.2.raw
  modified_base (196)..(196): a, c, t, g, unknown or other
  modified_base (222)..(222): a, c, t, g, unknown or other
  modified_base (230)..(230): a, c, t, g, unknown or other
  modified_base (247)..(247): a, c, t, g, unknown or other
  modified_base (479)..(479): a, c, t, g, unknown or other
  modified_base (586)..(586): a, c, t, g, unknown or other
  modified_base (604)..(604): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccattccctccctgtctgctatctagtagganacagatcacctatcacttggccgggngagtcganactattagcattgtatntagtaaagttggaatacgaacgaacaaaaccgacggaaccaccgaacccctaaactcctagacctccgtacgactcgactaacttcccgtaacgtttacgggaaaaccgtcggggtaccctaagtacgtacggttagaggtaggtaaacgtcggtcgtgtagggtactagtttacttttactacgactatcgacgatcgggctagacgacgtcgtaaggacgaactacgtanacctaaagttactttaactacgtacgttaaaccaagttataagtgtaacgtcttcctaccgtcgtcgttacggggttcggggacggggttaacgtaggggtagacgnttacgaaggtcaagtggnggcctaacgctaacg

SEQ ID NO: 365378 - DNA, 670 bp, Homo sapiens
  misc_feature: GZ8MTXP01B9S06.51.67.G01.1.454.CMB.2.raw
  modified_base (194)..(194): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatcgacccagtctccatccctccctgtctgcatctatagganacagaatcacatcacgtggccgggagagtcgagactattagctatgtatctagaattggtatacaagaaccaaaacgacgggtaaccacgaacccctaaactcctagactaccctagtatcgactaacttacctaacggttacggaaaccggtacggggtacctaacgtaccggttaagggttaccgtagggtagggtaaacggttcgggtcgtcgggtaacggggtacttacggttaactttttacctacactactacgagtcggacggtcagacgtacgtctaacgaagtacttagtacaactaaacgttatttaacgttacgtacgtaataacgagttagtacgtaacgttcgtcccgtaccggtcttaacgggttccggggttaccgggggaaccggggttaacggtaagggttaggacgttacgttaccggtaagcggttaacggtggtacggacgttcgaaccccttaag

SEQ ID NO: 365379 - DNA, 667 bp, Homo sapiens
  misc_feature: GZ8MTXP01EKETX.51.67.G01.1.454.CMB.2.raw
  modified_base (228)..(228): a, c, t, g, unknown or other
  modified_base (270)..(270): a, c, t, g, unknown or other
  modified_base (462)..(462): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacgttggccgggcgagtcganactattagcatgtatctgaattggtatcaagacaaaaaccgngggaacacgacccctaaactcctgactcctacgactgacctactaccgtacgtttacggaaacgacggggtaccccaagtacgtaaaggttcgaaggtggtaaaagtgggtcgtacgtaggggtactaacgtttaactttttacttacaactatacgtaaggccgtagggctcgacgaggttctacgggaanacgtaattacgaacctaaagttaacttaacgtttactacgttaacaaacgtaagttaatacgtacgttaccgtacccttccccgtctaaccggttaaccgggtttcgggggaccgggggttaaaccgtaaacggggttaggaacgttacgttaacggaacggtacgtaaaccgttgggtcgttaccggttcgaaccgttaacccg

SEQ ID NO: 365380 - DNA, 680 bp, Homo sapiens
  misc_feature: GZ8MTXP01BU58Z.51.67.G01.1.454.CMB.2.raw
  modified_base (266)..(266): a, c, t, g, unknown or other
  modified_base (317)..(317): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagactattagcattgtatctgaattggtatcaagacaaaaccgngggacacgacccctaaactcctgactctacgatgcatcctatttaggaacnggggtcccagtcaaggttcagtaggaaagtggctcgtgggactaggttacttttacttcaaccctattacgacggacgacgggcttacgggactaacgtcccgtaagtaaaccggacgtaagtttacgaacctaaaccggtaagtttaaaccgtttaacgtacgggtttaaacccaaacgtagggttaaacttagggtaactttaaacccgggtacccttccccggtccgttaaccgttacccggggttttaccggggggacccggggggttaaacccgaaaggggggttccggaaagttcgttaacggtaacggacccggtaaacgttggggtacgggttaccccgtcgttaacccgtaacg

SEQ ID NO: 365381 - DNA, 718 bp, Homo sapiens
  misc_feature: GZ8MTXP01E1E6A.51.67.G01.1.454.CMB.2.raw
  modified_base (195)..(195): a, c, t, g, unknown or other
  modified_base (206)..(206): a, c, t, g, unknown or other
  modified_base (221)..(221): a, c, t, g, unknown or other
  modified_base (281)..(281): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatcgacccagtctccatccctccctgtcctgcatctatagganacagaatcacntcacgttggccgggntagtcgagtactagttagctatgtatctagaattggtactacaacgaaccgaaaaaccgngggaccaccgaccccctaaatcctgactcctagatcgactacttaccgtagttacggaaacgtcgggtacctagtacgtaagtcgtaggtggtaaacgtcggcgttacgagggtaaccttatttactttttacctacaactacttacgacgaacgtacgggtctacggtaccgacgttaccgtaagggaaacgtacttaacgtacgtaaacccttaaagttacgtttaaacgttaactaacggttaaccaaacgttaaggttacttaaacgggtacttaacccgggttccctcccccggtagttaacccgggtttaacgggggtttaccccggggggaaggggttaaacccgttagggggtaacgaaggttaacgttaccggaacggggtaccgttaaggttcgggacggttccttaaccggaaccgtttaacccgg

SEQ ID NO: 365382 - DNA, 634 bp, Homo sapiens
  misc_feature: GZ8MTXP01CMCBW.51.67.G01.1.454.CMB.2.raw
  modified_base (191)..(191): a, c, t, g, unknown or other
  modified_base (214)..(214): a, c, t, g, unknown or other
  modified_base (230)..(230): a, c, t, g, unknown or other
  modified_base (298)..(298): a, c, t, g, unknown or other
  modified_base (416)..(416): a, c, t, g, unknown or other
  modified_base (441)..(441): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatcatagganacagatcacatcacttggcgggnagtcgagacattacgnattagtatcgtagaattggaatcaaacgaacaaaaaccgagggaacaaccgaacccctaaactcctanactccctgatcgacctactcccgtaagtttacgggaaaccgcggggtaccctaagtacgtaaaggtcgaaggtagggaaacgtgctgtagggtactagtttactttactacacctagnagcgtagctggacacgtctagaacnctagtacgaacaatagtttaaacttcctaggaacctaaggaagttattacggactttacccgggcccgtcccttagtcccgggttaaaccgggttcggggggtaaccgggggaaacccgtaaaggggttggaaagttacggttaaccgaacggttaaacgcgttgggggtaaccgcgtccgttaaccgtaacg

SEQ ID NO: 365383 - DNA, 642 bp, Homo sapiens
  misc_feature: GZ8MTXP01EVQ35.51.67.G01.1.454.CMB.2.raw
  modified_base (193)..(193): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctatagganacagatcacatcacgttgccgggcagtcgagactattagcatgtatctagaattggtatacaagaacaaaacgacggaacaccgtacccctaaactcctagactccgtacgatcgactacgttaccgtaacgtttacggaaaccgtacggggtacctaacgttacgtaaggttacgaggtagggtaaagttcggtcgttacggtagggtacttagtttaactttttactacacctatacgagtacgacggtctgacacgtaccgtaagaacgtacctagttacgaacctaacgtaactttaacttaaccgtacgtaaacctaagtagttatacggtacttaccgtcctcccgtctaaccggttacgggttcgggggacggggttaaccgtaagggtcgacgttcttacggaaggtaccgtaagtggtacgttcgtcgttaaccgtaacg

SEQ ID NO: 365384 - DNA, 750 bp, Homo sapiens
  misc_feature: GZ8MTXP01AJU8T.51.67.G01.1.454.CMB.2.raw
  modified_base (215)..(215): a, c, t, g, unknown or other
  modified_base (262)..(262): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcactggccggnagtcgagacattagctatgtatctagattggatcagaacaaaaccgngggaccacgacccctaaactcctagtaactcctacgactcgacctaacttaccctaaacggttttacgggaaaaccgtacggggggttaccccctaagttaccggtaaacggggtttaccgtaaggggttaggggtaaaaaacgggttcggggtccgttaccggttaacggggggtaaacctttaaacgggttttaaccgtttttttaaccgttttaccccgaaacccttacgtttacccgtaacggtacccggaaggggtaccttcgggaacccgtacggtaccccgttaaaggaaacggtaccttaagttacgtaaccctaaagttaactttaacggtttactacggttaacctaaacgtaggttaacctagtacttaaccgtcccgtacccgtgtaacccgttcgggtttccgggggacggggttaccgaagggttcggagcgttacgaaggtccgtaagtcggtcgacctcggaacgtaacccg

SEQ ID NO: 365385 - DNA, 627 bp, Homo sapiens
  misc_feature: GZ8MTXP01A0WT8.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacgttggccgggcgagtcgagactattagctatgtatctagtaattggtatcgaagaacaaaaaccgacggaccacgaacccctaaactcctagactccgacgatcgactactaccgtacggttaacggaaaccgtacggggtacctaacgttacgtaacggttacgaggtagggtaaacgggttcggtccgtacggtagggtaactacgtttaacttttaccttacaacctagtacgaagcgtaacggtcgtagaccgtacgtaccgttaagaaacgtacctaagtacgaacctaaatacgtttaacttactagtaactaacgtagttactagtataccgtccgtaccgtcgtaacgtacgggttcgggacgggttacgtaaggtagagacgagaacgcgtaagtcggacgctcgaacgtc

SEQ ID NO: 365386 - DNA, 569 bp, Homo sapiens
  misc_feature: GZ8MTXP01C1IW6.51.67.G01.1.454.CMB.2.raw
  modified_base (190)..(190): a, c, t, g, unknown or other
  modified_base (192)..(192): a, c, t, g, unknown or other
  modified_base (213)..(213): a, c, t, g, unknown or other
  modified_base (411)..(411): a, c, t, g, unknown or other
  modified_base (490)..(490): a, c, t, g, unknown or other
  modified_base (522)..(522): a, c, t, g, unknown or other
  modified_base (529)..(529): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatcataggananagaatcacatcagttgccggnagtcgagactatagcatgtatctgaattggtatacgaagaacaaaaacgacggacaccgtacccctaaactctagactcctacgatgacctactaccgtagtttacggaaacgtcggggtaccctaagtacgtaaggtcgaggtggaaagtcggctacgtagggaactagttatttacttacaccatacgagcaggcngacgacgactagagaactagtacaactaatacgttaattacctattaaccaagtagtatacgtataccggtcctccgtntcgtaacggttcgggggacgggaacgtaaggngttacgngttacgaagtaccgtaagtggtcggacttcgaacctaacg

SEQ ID NO: 365387 - DNA, 487 bp, Homo sapiens
  misc_feature: GZ8MTXP02GG2UU.51.67.G01.1.454.CMB.2.raw
  modified_base (478)..(478): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtccatcaagttcagtgaagtggctctgggacagtatttactttcacctatcagcaggctgcagcctgaagacattgcaaacatattactgtacaacagtatgatagtctcccgctcacgtttcgggcgggggtaccaagggtcgagagtcaagcgaacttggngctcgacac

SEQ ID NO: 365388 - DNA, 488 bp, Homo sapiens
  misc_feature: GZ8MTXP02HVPJ6.51.67.G01.1.454.CMB.2.raw
  modified_base (217)..(217): a, c, t, g, unknown or other
  modified_base (381)..(381): a, c, t, g, unknown or other
  modified_base (383)..(383): a, c, t, g, unknown or other
  modified_base (387)..(387): a, c, t, g, unknown or other
  modified_base (389)..(389): a, c, t, g, unknown or other
  modified_base (391)..(391): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgaattggtatcagcaaaaaccagggacagcccctaaatcctgatcctcgatgcatccactttgaaacaggggtccatcaaggttcagtgaagtggctctgggacagtatttacttcaccatcagcaggctgcagcctgaananatanananatattatatacaacatatagtatatactcctctctacgttacggtacggggacggaacggtacggacgagacgaagacgacgtacgtgcgtcgacac

SEQ ID NO: 365389 - DNA, 478 bp, Homo sapiens
  misc_feature: GZ8MTXP02FN51P.51.67.G01.1.454.CMB.2.raw
  modified_base (457)..(457): a, c, t, g, unknown or other
tcagcgatcgtatacacgaccggtgctcgatttagagtatacatattgggtttgggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaagttcagtggaagtggctctgggacagatttactttcaccatcagcaggctgcagcctgagacattgcaacatattactgtcaacagtatgatagtctcccgctcacgtttcggcgggggtaccaagggtcgagntcaagcgaactgtggctgcac

SEQ ID NO: 365390 - DNA, 498 bp, Homo sapiens
  misc_feature: GZ8MTXP02GIVGG.51.67.G01.1.454.CMB.2.raw
  modified_base (310)..(310): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccagggacagacccctaaatcctgatcctcgatgcatccactttgaaacngggtccatcaagttcagtggaagtgctcgtgggacagtatttacttcaccatcagcaggctgcagcctagaagacattagacaaacattattactgtacaaactagtatagatagtctcccgctcgtacgtttcggggcgggggaccaagggtcggagatacgaagcgaactggtggctggacaaccg

SEQ ID NO: 365391 - DNA, 502 bp, Homo sapiens
  misc_feature: GZ8MTXP02HWYHX.51.67.G01.1.454.CMB.2.raw
  modified_base (342)..(342): a, c, t, g, unknown or other
  modified_base (491)..(491): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctcccatcctccctgtctgcatctataggagacagaatcaccatcacttgccgggcagtcgagacattagcatgtatctgaattggtatcagcaaaaaccagggacagacccctaaactcctgatcctcgatgcatcctacttggaaacaggggtcccatcaagttcagtggaagtgctntgggacagtatttactttcaccatcagcaggctgcagctagaagacattgcaaacattattactgtacaactagtatgatagtctcccgcttcgacgttttcgggcgggggacctaagggtcggacgatacgaagaccgaaacgtcggngtctcgacacg

SEQ ID NO: 365392 - DNA, 497 bp, Homo sapiens
  misc_feature: GZ8MTXP02I7T40.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttggaaacaggggtcccatcaaggttcagtggaagtggctcgtgggacagtattttactttcaccatcagcaggctgcagcctgaaagacattgacaaacattattactgtacaacagtatgaatgtactccgctcacgtttcgggcgggggaaccaagggtcggagatacgaagcgaacgtggtgactgacac

SEQ ID NO: 365393 - DNA, 552 bp, Homo sapiens
  misc_feature: GZ8MTXP02HMUVP.51.67.G01.1.454.CMB.2.raw
  modified_base (192)..(192): a, c, t, g, unknown or other
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggnagtcgagacattagcatgtatctgaattggtatcagacaaaaaccgagggacagacccctaaactcctgactcctcgatcgctactcctacgtttaggaaacgacggggttacccaatccgaaggtttcaggttagggaaacgttgggcgttcgtaggggtactagttatttttacttacacccatcagcaggctgcacgcctagaacgacattacgactaaactattaattactagtacaacagtatagatacgtctccgtctacgtaccgtttcggggacgggggtaccaagggtcgagacgtacgaacgcgaacgttgaggctacgacaacc

SEQ ID NO: 365394 - DNA, 511 bp, Homo sapiens
  misc_feature: GZ8MTXP02IW340.51.67.G01.1.454.CMB.2.raw
  modified_base (217)..(217): a, c, t, g, unknown or other
  modified_base (263)..(263): a, c, t, g, unknown or other
  modified_base (384)..(384): a, c, t, g, unknown or other
  modified_base (397)..(397): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaccngggaacagacccctaaactcctgactcctcgatgcatccactttagaaacaggggtccatcgaagttcagtggaagtggctcgtgggactagtattttacttcacctatcagcaggtttcngcagcctaggaanactattgactaaacattattactgtacaacagtatgaatagtctccgctcgtacgtttcgggacgggggacagggtggacgacgtacgaagcgtaacgtggagcgtcgactacg

SEQ ID NO: 365395 - DNA, 515 bp, Homo sapiens
  misc_feature: GZ8MTXP02HW6KD.51.67.G01.1.454.CMB.2.raw
  modified_base (404)..(404): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgactcctcgatgcatcactttgaacaggggtccatcaagttcagtggaagtggctcgtaggactagttattttacttacactatacgagacgaggctgacacgacgtagaacactattanactaaactattagtactagtaccaatagtatagatacgtctccgctcgtacgtttcggggacgggtacgtaggacgacgtagacgaagtcgaacgtcggtgcgtacgacac

SEQ ID NO: 365396 - DNA, 533 bp, Homo sapiens
  misc_feature: GZ8MTXP02HEQUI.51.67.G01.1.454.CMB.2.raw
  modified_base (292)..(292): a, c, t, g, unknown or other
  modified_base (386)..(386): a, c, t, g, unknown or other
  modified_base (526)..(526): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaccagggacacgacccctaaactcctgactccncgatgcatccactttggaacaggggtccatacgaaggttcaggtcggaagtggctcgtggggacagtatttactttcaccatcagcaggctgcngacctagaagactattagacaaactattattactagtaccaaagtagtatagtattacggtcctcccgtactccgtacgtttccgggggacgggggtaccgaaaggtcggaagactacgaagccgaacgtggtacggtcncgacacc

SEQ ID NO: 365397 - DNA, 510 bp, Homo sapiens
  misc_feature: GZ8MTXP02H85MZ.51.67.G01.1.454.CMB.2.raw
  modified_base (437)..(437): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgccgggcagtcgagacattagcatgtatctgaattggtatcagacaaaacagggacagcccctaaactcctgatcctcgatgcatccactttgaaacaggggtccatcaaggttcaggtggaagtggctgtgggacagtattttacttcaccatcagtcaggctgcagcctagaagacattagactaaacattattactagtacaaacagtatgattacgtctcccgntcgtacgtttcgggacgggggacctaaagggtcggagtagtacgaaggcgtaaacgtgtggcctggaccaacg

SEQ ID NO: 365398 - DNA, 513 bp, Homo sapiens
  misc_feature: GZ8MTXP02HK5AI.51.67.G01.1.454.CMB.2.raw
  modified_base (345)..(345): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccagggaacacgcccctaaactcctagactcctcgatgcatccatttaggaaacaggggtccatcaagttcagtgaagtggctcnggacagtatttacttcaccatcagcaggctgcagcctagaagacattcgacaaactattaattactagtaccaagtagtatgatacgtctcccgcttacgtaccggtttcgggacgggggaaccaagggttcggaagatacgaagcgtaagtcgtaggctcgacaccg

SEQ ID NO: 365399 - DNA, 523 bp, Homo sapiens
  misc_feature: GZ8MTXP02GX0NB.51.67.G01.1.454.CMB.2.raw
  modified_base (192)..(192): a, c, t, g, unknown or other
  modified_base (218)..(218): a, c, t, g, unknown or other
  modified_base (315)..(315): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttggccgggnagtcgagacattagcatgtatctgaattggtatcagacaaaaaccagggacacgcccctaaactcctagactcctcgatgcatccacttaggaaacnggggtccatcaagttcagtggaagtggctcgtgggacagtatttacttcacatcagcaggctgcacgcctagaagacattagacaaactattattactagtacaactagtatagatacgtacctcccgctcgtacgtttcggggcgggggtaacctaaggggtcgagactacgaaggcgtaaacgtggacggtcgtacggactaaccg

SEQ ID NO: 365400 - DNA, 538 bp, Homo sapiens
  misc_feature: GZ8MTXP02FIILQ.51.67.G01.1.454.CMB.2.raw
  modified_base (392)..(392): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgccgggcagtcgagacattagcatgtatctgaattggtatcagacaaaaaccagggacagacccctaaactcctgatcctcgatgcatccaactttggaaacaggggtccatacaaggtcagtggaagtgggctcgtgggacagtattttactttcaccatcagcaggctgcagcctagaaanacatagacaatataatactatacaactagtatagatacgtcctcccgctaccgtacggttacgggggaccgggggaacgtaaagggtacggaacgacgtaacgaaacggtacgtaaacgtcggtacggtacgtacggacctaaccg

SEQ ID NO: 365401 - DNA, 489 bp, Homo sapiens
  misc_feature: GZ8MTXP02I6RWD.51.67.G01.1.454.CMB.2.raw
  modified_base (384)..(384): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccagggacagcccctaaactcctgatcctcgatgcatccactttggaacaggggtccatcaagttcagtggaagtggctctgggacagtatttacttcaccatcagcaggctgcagcctagaanacattgactaaacattattactgtacaacagtatgaatagtctacccgctactacgtttcgggcgggggaactagggtgagatcgaagcgaatggtgctgactac

SEQ ID NO: 365402 - DNA, 485 bp, Homo sapiens
  misc_feature: GZ8MTXP02JYVUB.51.67.G01.1.454.CMB.2.raw
  modified_base (309)..(309): a, c, t, g, unknown or other
  modified_base (478)..(478): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatcactttgaaacngggtccatcaagttcagtggaagtgctctgggacagtattttactttcaccatcagcaggctgcagcctgaagacattgcaaacattattactgtacaacagtatgatagtctcccgctcacgttcgggcgggggaccaaagggtcgacgagtcaagcgaactgtggcncgacacg

SEQ ID NO: 365403 - DNA, 512 bp, Homo sapiens
  misc_feature: GZ8MTXP02G2C0K.51.67.G01.1.454.CMB.2.raw
  modified_base (343)..(343): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttaggaaacaggggtccatcaagttcagtggaagtggctntgggacagtatttactttcaccatcagcaggctgacagcctgaaagacattagactaaacattattactgttacaactagtatgatagtctccgctcacgtttcgggcgggggaaccaagggtcggagtacgtacgaaggtcgaaacgtggtagcgtacggactaaccg

SEQ ID NO: 365404 - DNA, 566 bp, Homo sapiens
  misc_feature: GZ8MTXP02I8NFB.51.67.G01.1.454.CMB.2.raw
  modified_base (378)..(378): a, c, t, g, unknown or other
  modified_base (389)..(389): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccagggacagcccctaaactcctgatcctcgatcgcatccactttaggaaacacggggtccatcgaagttcaggtggaagtggctcgtgggactagtattttacttcacctatcagcncgggctgaccncgtaccgtagaacgactagtacgacaaactattaattacgtacgtacaaacgtagtatagtacttacgtccgtacccgtacttaccgtacggttaccgggggaccgggggtaaccgtaaggggtacggacgtacgtaacgaacggtacgtaacgtcggtcggaccgtacgacctacg

SEQ ID NO: 365405 - DNA, 483 bp, Homo sapiens
  misc_feature: GZ8MTXP02IVMPO.51.67.G01.1.454.CMB.2.raw
  modified_base (217)..(217): a, c, t, g, unknown or other
  modified_base (411)..(411): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgaattggtatcagcaaaaaccagggacagcccctaaactcctgatcctcgatgcatccactttgaaacaggggtcccatcaagttcagtgaagtgctctgggacagtattttactttcaccatcagcaggctgcagcctgaagacattgacaacatattactgtacaaacngtatgatagtactccgctcacgtttcgggacgggggaccaagggtgacgagtcaagcgaactgtgctgctac

SEQ ID NO: 365406 - DNA, 488 bp, Homo sapiens
  misc_feature: GZ8MTXP02HMIPS.51.67.G01.1.454.CMB.2.raw
  modified_base (393)..(393): a, c, t, g, unknown or other
  modified_base (479)..(479): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagcatgtatctgaattggtatcagacaaaaaccagggacagcccctaaactcctgatcctcgatgcatccactttggaaacagggtccatcaagttcagtggaagtgctctgggacagtatttacttcaccatcagcaggctgcagctagaagacattgacaanacttattactgtacaaacagtatgatagtctccgctctacgtttcgggacgggggaccaaggtcgagatacgaagcgaacgtcggngcacgacac

SEQ ID NO: 365407 - DNA, 500 bp, Homo sapiens
  misc_feature: GZ8MTXP02IHIOU.51.67.G01.1.454.CMB.2.raw
  modified_base (465)..(465): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctgatgcatccactttggaacaggggtccatcagtcagtggaagtgctctgggactagtattttactttcaccatcagcaggctgcagcctagaagacattgacaaacattattactgtacaacagtatgatagtctccgctcacgtttcgggcgggggtaaccaagggtcggaagngtacgaaggcgaacgtcggtggcgtacgctaaccg

SEQ ID NO: 365408 - DNA, 489 bp, Homo sapiens
  misc_feature: GZ8MTXP02H2CZW.51.67.G01.1.454.CMB.2.raw
  modified_base (418)..(418): a, c, t, g, unknown or other
  modified_base (464)..(464): a, c, t, g, unknown or other
tcagcgatcgtatacacgaccggtgctcgatttagagtatacatattgggtttgggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagcaaaaaaccaggggaacagaccccctaaactccctgatcctcgatgcatccatttgaaacacggggtccatcgaaaggttcagtggaagtggctcgtggacagtattttactctacatcagcaggctgcagcctgaagcaattgacacattattactagtcaanagtatgatagtctccgctcacgtttcgggacggggaccaggtgagntcgaagtcgaactggtagctcgcac

SEQ ID NO: 365409 - DNA, 554 bp, Homo sapiens
  misc_feature: GZ8MTXP02IOFNI.51.67.G01.1.454.CMB.2.raw
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaacagggacacgcccctaaactcctgatcctgatcgcatccacttagaacaggggtccatcagttcagtggaagtggctctgggactagtattttacttcacatcagcaggctgcacgcctagaagacattacgactaaactattaacttactagttaccaactagtatgtaatgttacctcccgtcttccgtaccggttttaccggggaccggggggtaaacccgtaaggggttacgggaagtacgttacggaaaggtacccggtaaagttcggtacggcttacggacctaaccg

SEQ ID NO: 365410 - DNA, 498 bp, Homo sapiens
  misc_feature: GZ8MTXP02JBDOF.51.67.G01.1.454.CMB.2.raw
  modified_base (395)..(395): a, c, t, g, unknown or other
  modified_base (402)..(402): a, c, t, g, unknown or other
  modified_base (414)..(414): a, c, t, g, unknown or other
tcagcgatcgtatacacgaccggtgctcgatttagagtatacatattgggtttggggagtcccaacaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctgaaattggatcaagacaaaaaaccgagggactagacccctaaactcctgatcctcgatgcatcctactttaggaaacaggggtcccatcaagtcagtggaagtggctcgtgggactagtattttacttcaccagtcagcagctgacaactgaanacatganacatatatatanacatatatatatactacctctctacgtacggtacggggacggacggtacggacgagacgacgaagacgtacgtagcgcgcacac

SEQ ID NO: 365411 - DNA, 592 bp, Homo sapiens
  misc_feature: GZ8MTXP02HOV0T.51.67.G01.1.454.CMB.2.raw
  modified_base (192)..(192): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgtcgggcgagtcgagacattagcatgtatctgaattggtatcagacaaaaccgagggacagacccctaaactcctagactcctcgatgctatcctactttaggaaacgaggggtaccatacgagttcagtggaacgtgctgtgggacagttactttacgtcacatcagcgaggctgcacgtcctagaaagtactattagactaaactaatttaagttactacggttacaaacgtagggttaataggaacttacggtcctaccccggtcttaccggttaccggttttaccgggggaccggggggtaaacccaaggggttaccggagtaacgttaccgtaaacggacggtaaacgtcgggttacggcgttacggacctaacccg

SEQ ID NO: 365412 - DNA, 486 bp, Homo sapiens
  misc_feature: GZ8MTXP02GAYAK.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactccctgatcctcgatgcatccactttggaaacaggggtccatcaagttcagtggaagtggctctgggacagtattttactttcaccatcagcaggctgcagcctgaagacattgcaacataattactgtcaacagtatgatagtctccgctcgactttcggcgggggaccaagggtggtagatcaagcgaacgtgtggctgcaacc

SEQ ID NO: 365413 - DNA, 618 bp, Homo sapiens
  misc_feature: GZ8MTXP02IIT6H.51.67.G01.1.454.CMB.2.raw
  modified_base (218)..(218): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggngagtcgagacattagcatgtatctgaattggtatcagaaccaaaaaccgaggggaacacgacccctaaactcctgaactccctgatcgacattaccctacgtttacggaaaaccgtacggggtccccaagtacgtaaagggtttcaagggttagggaaaggttcgggtcgttcggtaggggaactagtttactttttaactttacacctatcagcaagggtctgacagcctaggaaacactattcgacaaactattaacttactagtaccaaatagtatagtacttacgtcctcccgtctcggtaaccgtttcgggggaccgggggtaaaccaaaggggtcggaaacgtacgttaacgaaaggtcgtaaaacgttgggtaacggcgttacgactaaaccg

SEQ ID NO: 365414 - DNA, 517 bp, Homo sapiens
  misc_feature: GZ8MTXP02HDL9O.51.67.G01.1.454.CMB.2.raw
  modified_base (263)..(263): a, c, t, g, unknown or other
  modified_base (309)..(309): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccnggacagcccctaaatcctgatcctcgatgcatccactttggaaacnggggtccatcaagttcagtggaagtggctgtgggacagtatttacttcacatcagcaggctgcagcctgaaagcattgacaaacattatactagtacaaactagtaatgtaacttaggtcctaccccgcttacgaccgttttccggggacgggggtaccaaggggtcggaacgtgtacgaaggacgtaacgtggagcgtagacctacg

SEQ ID NO: 365415 - DNA, 517 bp, Homo sapiens
  misc_feature: GZ8MTXP02HNK6B.51.67.G01.1.454.CMB.2.raw
  modified_base (317)..(317): a, c, t, g, unknown or other
  modified_base (399)..(399): a, c, t, g, unknown or other
  modified_base (420)..(420): a, c, t, g, unknown or other
  modified_base (425)..(425): a, c, t, g, unknown or other
  modified_base (445)..(445): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattgggtatcaagacaaaaaaccaggggacagccccctaaactcctgatcctcgatgcatccatttaggaaacngggtaccatacaaggttcaggtggaagttggctcgtgggacagtattttacttacaccatcagcaggctgcagcctaggaanacattgctaaacattattacngttanaacagtatagtatatctccnctacgtacgttcgggtacgggggaccgaacggacggacgaagtacgaagacgacgtacgtggcgtcgacacc

SEQ ID NO: 365416 - DNA, 624 bp, Homo sapiens
  misc_feature: GZ8MTXP02GAZR3.51.67.G01.1.454.CMB.2.raw
  modified_base (256)..(256): a, c, t, g, unknown or other
  modified_base (267)..(267): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcagtcgagacattagcatgtatctgaattggtatacganaaaccaaacgnggacaccgtacccctaactcgtagactccgtagatcgactactccgttacgttaaacggaacggtaccgggtaccagtacgtaacggtacgagggtaggtaaggtcggtcgttacgggacggggtaactagtttaactttttaacttaccaacctatcgaacgcgacggtcacgacgacgtacgtaaggaaacctaatgtaccgaaacaaacttatttaactagtacgtaaccaaagttagtagttacgtaacttcgtacccgtaccctcttaaccgttccggggttacgggggaccggggtaaacgtagggtcggaaatgtaacgaaggtaccgtaggtcggtcgacgtcacctac

SEQ ID NO: 365417 - DNA, 503 bp, Homo sapiens
  misc_feature: GZ8MTXP02FONXJ.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaaccagggacagacccctaaactcctgatcctcgatgcatccactttggaaacaggggtccatcaaggttcagtggaagtggctctgggacagtatttacttcacatcagcaggctgcagcctagaagacattgacaaactattattactgtacaaacagtatgatagtcctcccgctcgtacgtttcgggacgggggaaccaagggtcgaagatacgaaagcgaactgacggctcgctaaccg

SEQ ID NO: 365418 - DNA, 496 bp, Homo sapiens
  misc_feature: GZ8MTXP02JG7H5.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaatcctgatcctcgatgcatccactttggaaacaggggtcccatcaagttcagtggaagtgctctgggacagtatttactttcacctatcagcaggctgcagcctagaagacattgacaacattatactgtacaacagtatgatagtctccgctcgacgtttcgggacgggggtacaagggtggaacgatacgaagcgtaaactggtagctagcaaccg

SEQ ID NO: 365419 - DNA, 526 bp, Homo sapiens
  misc_feature: GZ8MTXP02H88RX.51.67.G01.1.454.CMB.2.raw
  modified_base (217)..(217): a, c, t, g, unknown or other
  modified_base (315)..(315): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaaattggtatcagacaaaaccagggacacgacccctaaactcctgactcctcgatgcatccatttaggaaacnggggtccatcaaggttcagtggagtgctcgtagggacagttattttacttcaccatcagtcagctgcagcctagaactacgattagacaaactattaattacctagtaccaaatagtatggaattacgtcctacccgtcttacgtacggtttcggggacgggggtaccgagggtaggacgtatacgaagcgaagtcggtagctcgacctac

SEQ ID NO: 365420 - DNA, 787 bp, Homo sapiens
  misc_feature: GZ8MTXP02HVKC2.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctgactcctacgatgactactcctacgtttaggaaaaccgacgggggttaccccacgtaccgtaaaagggtttcgaagggttaggggtaaacggttggggtccgttaccgggttagggggtaaaccttaaggggttttaaactttttttaacccgtttttaccaaacccccgtaaagtttccaaacggtcccgtaaaggggcccttcgggacccaacgggtaccccttacggggaaaagtaccgtaatttacggaacctaaaaccgtaatttaaacgtttaaaccttcggttaacccgaaaactaagggtttaaacttagggtaaacctttaaacggttccccgtttaacccccggtacctttccggttaaaccgggtttttcccggggggaacccgggggggtaaaccccgtaaacgggggttacgggaaaccggtaagttaaccggaaaggacccggtaaaacgttcggggttagggacctcggttaacccgtaaccccg

SEQ ID NO: 365421 - DNA, 580 bp, Homo sapiens
  misc_feature: GZ8MTXP02JIFRN.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttggccgggcgagtcgagacattagcatgtatctgaattggtatcagacaaaaccgagggacacgacccctaaactcctagactcctcgatgacatctacgtttacggaacgacggggtccactcgaagttcgagtggaaggtgcgtcgtagggactagtatttactttacacctatcagcgaggctgactacgacctagaagactattacgactaaacctattacttaacgtgtaaccaaagtaggtatagtatacggttcctaccgtctacgtaaccggtttccgggggaccgggggtaaccgtaaggggtcggtaacgacgttaacgaacggtacgtaacgttcggtacggacgttacggactaaacccg

SEQ ID NO: 365422 - DNA, 531 bp, Homo sapiens
  misc_feature: GZ8MTXP02FPJUD.51.67.G01.1.454.CMB.2.raw
  modified_base (216)..(216): a, c, t, g, unknown or other
  modified_base (353)..(353): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgccgggngagtcgagacattagcatgtatctgaattggtatcagacaaaaaccgagggacacgacccctaaactcctgactcctacgatgcatcctactttaggaaacacggggtccatcgaaggttcaggtggaagtgctcgngggacagtatttacttcacctatcagtcaggctgcacgtcctagaaagacagttagacaaactatattactagtacaaactagtatgactagtcctccgctacgtacgtttcggggacgggggtaccaagggtggaacgtagtacgaagtacgaacgtggtcggactcggacctaacg

SEQ ID NO: 365423 - DNA, 526 bp, Homo sapiens
  misc_feature: GZ8MTXP02FK378.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccgagggacacgacccctaaactcctgactcctcgatgcatcctactttagggaaacacggggtcccactcgaaaggttcaggtggaagtggctcgtagggactagtattttactttcacctatcagcaggctgcagcctagaacgactattgacaaactatattactagttacaaacagtatgtaatacgtctacccgtctcgtacgtttcggggacgggggtacagggtcgaacgatacgaagcgaacgtggtagctacgctac

SEQ ID NO: 365424 - DNA, 593 bp, Homo sapiens
  misc_feature: GZ8MTXP02IV0Y9.51.67.G01.1.454.CMB.2.raw
  modified_base (231)..(231): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatccaccatcacgttcggccgggcgaggtcganactattagcatgtatctagtaattggtatacaagaacaaaaacgagggaacacgacccctaaactcctagactcctcgatgactactactacgtttaaggaaacgtacggggtaccagtacgtaaggtcaggtgaagtgcgtcgtggactagtacttttactacactatcgagtcgaggctagactacgactagaaacgtatattacgaacctaaactattattaacctattaaccaaagtagtatagtaacgtacgtcccgtaccgtaccttacgtaccgggtttaccgggggacgggggtaaacaaaggggtcgaagtaactacgaacgtacgtaacgtggtcggacctaggacctaacg

SEQ ID NO: 365425 - DNA, 533 bp, Homo sapiens
  misc_feature: GZ8MTXP02GLY2I.51.67.G01.1.454.CMB.2.raw
  modified_base (217)..(217): a, c, t, g, unknown or other
  modified_base (343)..(343): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgaattggtatcagacaaaaaccgagggacagacccctaaactcctgactcctcgatgcatccactttaggaacaggggtcccatcaagtcagtggaagtgctngggacagtatttacttcacatcagcaggctgcagcctagaagacattagacaaactattaattactagtacaaactagtatagattacgtcctcccgacttacgtacggtttcggggaccgggggtaaccaggggtaggaacgtacgtacgaaacggcgtaaacgtcggtacggcgttcggacctaaccg

SEQ ID NO: 365426 - DNA, 629 bp, Homo sapiens
  misc_feature: GZ8MTXP02HF5K9.51.67.G01.1.454.CMB.2.raw
  modified_base (218)..(218): a, c, t, g, unknown or other
  modified_base (269)..(269): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacgttggccgggnagtcgagacattagcatgtatctagtaattggtatcaagaacaaaaaccgngggaccaacgacccctaaaactcctagactccacgatgactactcctaacgtttaggaaaaccgtacggggtaccccaagttaccgtaaacgggttcgaagggtagggtaaaggttcgggccgttcgtagggggaaccttaggttaactttttacttacctaaccctatcgagtcgaggtctcgacacgctagaaagactaagttacgactaaactatttaattacgtagttacaaacgtagtatagaacttacgtcctacccgtcttacgttaccgggttacggggaccgggggtaactaaacggggtgaacggtactacggaacggtacgtaacgttggtcggtcgtacgacctaacg

SEQ ID NO: 365427 - DNA, 517 bp, Homo sapiens
  misc_feature: GZ8MTXP02JWIOJ.51.67.G01.1.454.CMB.2.raw
  modified_base (334)..(334): a, c, t, g, unknown or other
  modified_base (367)..(367): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccatttgaacagggtccatcagttcagtgagtgctcngggacagtatttactttcaccatcagcaggtcngcagctagaatacagtagacaactattacttactagtacaaacgtagttatagtactacgtcctcccgtctacgtaccggttcggggacgggggtaaccgagggtacggagtacgtacgaacgacgtacgtcggtcgacgtcgactaccg

SEQ ID NO: 365428 - DNA, 499 bp, Homo sapiens
  misc_feature: GZ8MTXP02JSC92.51.67.G01.1.454.CMB.2.raw
  modified_base (311)..(311): a, c, t, g, unknown or other
  modified_base (485)..(485): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccagggacagacccctaaatcctgatcctcgatgcatccactttggaaacnggggtccatcaaggttcagtggaagtgctctgggacagtattttactttcacatcagcaggctgcagcctgaagacattagcaaacattatactgtacaacagtatgatagtcctccgtctctacgtttcgggacgggggaccaaggggtcgacggtatcgaagcgaacttggnggctacggctaccg

SEQ ID NO: 365429 - DNA, 627 bp, Homo sapiens
  misc_feature: GZ8MTXP02H47WM.51.67.G01.1.454.CMB.2.raw
  modified_base (192)..(192): a, c, t, g, unknown or other
  modified_base (266)..(266): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttggccgggcagtcgagacattagcatgtatctgaattggtatacagaacaaaaacgngggaccacgacccctaaacgtctgaactcctgatcgactataccgtatttacggaaaccgtaggggtaccctataccgtaaaggttcgaaggttggaaggttcggctcggtagggactagttaacttttacttacaacctatcaagtcgaagcctgactaggcctaagaacgtactattacgactaaactatttaacttactacggtaacaaaacgtagttaaacttgtaacgttaacggtccctacccggtaaccttccgggtacggtttaccgggggaccgggggttaaacgacgggttagacgttaacgaacgaaacggcgtaaaccgttgggacggtacttacggaccgttaaaccg

SEQ ID NO: 365430 - DNA, 542 bp, Homo sapiens
  misc_feature: GZ8MTXP02HHYAC.51.67.G01.1.454.CMB.2.raw
  modified_base (192)..(192): a, c, t, g, unknown or other
  modified_base (263)..(263): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgaattggtatcagacaaaaacngggacacgacccctaaactcctgactcctcgaatgccactacctacgtttacggaaaacgacggggtacccagtaccgaaggttcaggtaggtaagtggcgtcgtaggggactagtattttacttacacctactcgagctaggctagctacgctaggaacactagttcactaacattatacgtatacaacagtatagatcgtctccgctcgacggtttcgggacgggggtaccgaggtcgacgtacgtacgaagtccgaagtcgtggctacgctaaccg

SEQ ID NO: 365431 - DNA, 777 bp, Homo sapiens
  misc_feature: GZ8MTXP02H8BBG.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgcgggcagtcgagacattagcatgtatctagtaattggtatacaagaacaaaaaccgagggaacacgacccctaaactcctagactcctcgaatcgactacttaccaacgtttaacgggaaaccggtacggggtacccctaagtacccgtaaagggtttacgaagggttaggggaaacggttcgggtccgttaccgggttaagggggaaacctttaaggtttaaaccttttttaacctttacctaaacccttaactaccggaaacgtaccgacggggttacctacggacccgaacggtaccccgttaaagggaaaaccggtaaccgttaatttaccggaaacttaaaaccgttaaattttaactttaacccgtaaggttaaccaaaccgtaaggttaatacgggttacttaacggttcccctaccccgggttacctttaccggtaacccgggggtttacccgggggaaacggggggttaaaccctaaagggggttacggaaccggttaataaccgggaaggtaacccggtaaacggttggacggtacgtaccggtaaccctaacccg

SEQ ID NO: 365432 - DNA, 568 bp, Homo sapiens
  misc_feature: GZ8MTXP02FR8EK.51.67.G01.1.454.CMB.2.raw
  modified_base (192)..(192): a, c, t, g, unknown or other
  modified_base (218)..(218): a, c, t, g, unknown or other
  modified_base (364)..(364): a, c, t, g, unknown or other
  modified_base (414)..(414): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcacatcacgttggccgggnagtcgagacattagcatgtatctgaatggtatcagacaaaaccagggacacgacccctaaactcctagactcctacgatcgacactcctacgtttacggaaacgacggggtcccaattccgaaggttcgaggtaggaagtggctgngggatagtatttacttacacctatcagcgaggctagcacgtacctagaanactatacgacaaactattaacttacttagtaaccaataggtatcgtaatcgtacctcccgtcttacgtacgggtttccggggaccgggggttaaccgaagggtacggaagacgttacgaaaggtcgtaacgtggtcgacgtcggaactaacccg

SEQ ID NO: 365433 - DNA, 555 bp, Homo sapiens
  misc_feature: GZ8MTXP02G53XL.51.67.G01.1.454.CMB.2.raw
  modified_base (260)..(260): a, c, t, g, unknown or other
  modified_base (276)..(276): a, c, t, g, unknown or other
  modified_base (311)..(311): a, c, t, g, unknown or other
  modified_base (377)..(377): a, c, t, g, unknown or other
  modified_base (398)..(398): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagcatgtatctgaattggatcagacaaaacnggacacgcccctaaancctagactcctgatgacatccacgtttaggaaacncgggtaccagtacaaaggttcaggtaggaagtggctcgtaggacagttatttactttacacctatnagcaggctgcagcctagaaanactatagactaaactattagtactagtaacaagtagtatacgtatcgtcccgtccgtacttacggttaccgggttacgggggaccggggtacgtaaagggtacgaacgtaacgtaacgaacggtacgaacggttcggtacggacgtacgtacgtacg

SEQ ID NO: 365434 - DNA, 589 bp, Homo sapiens
  misc_feature: GZ8MTXP02IARHJ.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccgagggaccacgacccctaaactcctgactcctcgatgcatcctacgtttacggaaacgacggggtccagtacgaaggttcaggtggaagtggcgtcgtggggactagttacttttacttcacatcagtcgacggctggacacgtccgtagaaagacattacgacaaactattacttactgtaacaaacgtagtataggtactacgtccgtcccgtcttaccgtaccggtttacgggggaccggggggtaaccgaagggggttcggaaagtacgttacgaacggtacccggtaaagtcgggttagggaccttcggtaccgaacccg

SEQ ID NO: 365435 - DNA, 531 bp, Homo sapiens
  misc_feature: GZ8MTXP02GWH0S.51.67.G01.1.454.CMB.2.raw
  modified_base (192)..(192): a, c, t, g, unknown or other
  modified_base (217)..(217): a, c, t, g, unknown or other
  modified_base (521)..(521): a, c, t, g, unknown or other
  modified_base (524)..(524): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggngagtcgagacattagcatgtatctgaattggtatacagacaaaaaccgagggaacacgtacccctaaactcctagactcctcgatgacactcctacttaggaaacgacggggtaccacgtactaggtcaggtggaagtgcgtcgtgggactagttatttacttacactatcagcagcgtgacagccgtagaacgactatagacctaaatattaattactagtacaaactagtatagtatacgtcctaccgctcgtacgttcggggacgggggtacaagggtgacgatacgaagcgtaacgtggngcncgacacg

SEQ ID NO: 365436 - DNA, 619 bp, Homo sapiens
  misc_feature: GZ8MTXP02IX3YJ.51.67.G01.1.454.CMB.2.raw
  modified_base (216)..(216): a, c, t, g, unknown or other
  modified_base (588)..(588): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgtaattggtatcaaggaccaaaaaccgaggggaccaacgaccccctaaacgtccctagaactccctacgaatcgacctactcccttaaccgtttagggaaaaccgtacggggtacccagttaccgtaagggtttctaagggttaggaaaggttcgggtcgttcggtaggggaacctagttactttttactttaccacctaatcaacgcgaagggtctcgacgacgtccgtagaaagtactattgactaactaattattactgtaccaaagtagtaatgtaatcgtaccgtcccgtacttaccgtacggtttacgggggacgggggtaaaccaagggttcggaaaagtntacgaagcgtaacgtggtacgctgacctacg

SEQ ID NO: 365437 - DNA, 592 bp, Homo sapiens
  misc_feature: GZ8MTXP02H5E94.51.67.G01.1.454.CMB.2.raw
  modified_base (192)..(192): a, c, t, g, unknown or other
  modified_base (435)..(435): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttggccgggcagtcggagactattagcatgtatctgtaattggtatcaagacaaaaaccgagggaccagacccctaaactcctgactcctcgatgacactccaactttacggaaaaccgacggggtacccaagtcgtaaagggtttcaggtaggtaaggtcggctcgtaggactagttattttactttacacctatcagcaggctgacagacctagaagactattanactaaactattaattatacgtactaaagagttaagtagtagttacgttccgtacccggacttacgtaccgggttttccgggggacgggggaaccgtaacggggtacggagtaacgtacgaaacgtccgaaacgtggttacggcgttacgacctaccg

SEQ ID NO: 365438 - DNA, 542 bp, Homo sapiens
  misc_feature: GZ8MTXP02FICJE.51.67.G01.1.454.CMB.2.raw
  modified_base (415)..(415): a, c, t, g, unknown or other
  modified_base (454)..(454): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttggccgggcgagtcgagacattagcatgtatctgaattggtatcaagacaaaaacgagggacacgacccctaaactcctagatccctcgatgcatccttaacgttaggaaacacggggtaccatacgtaaggtcaggtggaagtggtctgagggactagttattttacttacacctatcagcgagctgcacggcctaaggacaacgnttacgacaaactataacttactggtacaacgtagtatanagtacgtcctccgctcgttacggtccggggacggggaacctaagggtcgaagctacgaacgtcgaacgtgggacgtcacgcctaaccg

SEQ ID NO: 365439 - DNA, 596 bp, Homo sapiens
  misc_feature: GZ8MTXP02G75V3.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctgtaattggtatcagaacaaaaaccgagggaacacgacccctaaactcctagactcctcgatgactatcctactttaggaaacgacggggtccatacgaaggttcgaggtaggaagtggctcgtgggactagtattttacttcactatctagcaggctgacacggcctaggaactactagttacgactaaactatttaacttactagtaacaaactagtatagtacttacgtcctaccctcttacgtaccggtttacgggggaccgggggtaaccgtaaacggggtggaacgtacgttacggaaaggtaccggtaaaaggttcggttaacggccgtttacggaacccgttaaccg

SEQ ID NO: 365440 - DNA, 724 bp, Homo sapiens
  misc_feature: GZ8MTXP02INPXC.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttcgccgggcgagtcgagacattagcatgtatctagaattggtatcaagaaccaaaaacgaggaccacgacccctaaactcctgactccctacgatcgacctactacccgtaacgtttacgggaaaaccgacgggggtacccctaagttaccgtaaacgggtttccgaaggtaggggtaaaggttcgggtccgtttcgtagggggaaacctaggtttaacctttttactttaccaccctaattcgaggtcgaagggtccgttacgacgacggtacccgttaggaaaacgtaccgtaatttacggaacctaaaactaactttaactttacctacgtaaccaaacgtagttaacgtgttaaacttacgttacccgtcccgtaccgttaccgtaccggggttttaccgggggaccgggggttaaaccgagggggttaacggaacggtaacgttaaccggaaacggttaaccggaaaacggtttcgggtacgggtaccttcgggaacccgttaaacccg

SEQ ID NO: 365441 - DNA, 508 bp, Homo sapiens
  misc_feature: GZ8MTXP02HAYIQ.51.67.G01.1.454.CMB.2.raw
  modified_base (217)..(217): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgaattggtatcaagacaaaaaccagggacagcccctaaactcctagaactcctcgatgacatccactttaggaaacacggggtcccaatcaaggttcaagtggaagtggctcgtgggacagtattttacttcaccatcaagtcaggctgcagctgaaagcattgacaaacattattactagtacaatagtatagattagtctccgctcgtacgtttcgggacggggaccaagggtgagactacgaaagcgaaactggtaggctgacac

SEQ ID NO: 365442 - DNA, 717 bp, Homo sapiens
  misc_feature: GZ8MTXP02JM37B.51.67.G01.1.454.CMB.2.raw
  modified_base (276)..(276): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtcctccatccctccctgtctgcatctagtaggagacagaactcaccatcacgttggccgggcgagtcgagacattagcatgtatctagtaattggtatacagaaccaaaaaccgngggaaccacgacccctaaactcctagactccgtagatgacctataccctaacgtttaacgggaaacgtacggggtacccctaagtacgtaaacggtcgtaagggtaggtaaggttggccgttacggtaggggaacttaggtttacttttacttacaccctatcgaagtccgaggcctagacacgtacccgttaaggaactaacgtaacgtttacgaaactttaaaccaaatttttaaccgttaaccggttagtttaaaacccgaaactaaggtttaaacggttataaaggtttaccccgtcccgttaccccgttcgttacccggtttaaccggggttccgggggaccgggggttaaaaccggtaaggggttacgggaacggttaacaaccgggttaacggaacccggtaaggttcgggcggtacttaccggacttaacccg

SEQ ID NO: 365443 - DNA, 558 bp, Homo sapiens
  misc_feature: GZ8MTXP02GUBON.51.67.G01.1.454.CMB.2.raw
  modified_base (224)..(224): a, c, t, g, unknown or other
  modified_base (278)..(278): a, c, t, g, unknown or other
  modified_base (308)..(308): a, c, t, g, unknown or other
  modified_base (372)..(372): a, c, t, g, unknown or other
  modified_base (407)..(407): a, c, t, g, unknown or other
  modified_base (430)..(430): a, c, t, g, unknown or other
  modified_base (482)..(482): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctagtaggagacagaactcacctatccacttcggccgggngagtcgagactagttagctatgtatctagtaattggatacgagaacaaaaccgnggaaccacgacccctaaactccagactccngatcgctactcctacgttaaggaacgacggggtccacgtacgtagttcgaggtaggagtgctgngggtactagttatttactcaccatcgagcgtaggntagacacgctaagacgactatanacctaaatattatacgtcgtaacaacgtagtatgtaactccgtacctccgtntccggtacggttcgggggacggggtaacaggggtacgacgaacgtcgaaagcggtaactggacgtacgcgactacg

SEQ ID NO: 365444 - DNA, 558 bp, Homo sapiens
  misc_feature: GZ8MTXP02FOXSI.51.67.G01.1.454.CMB.2.raw
  modified_base (193)..(193): a, c, t, g, unknown or other
  modified_base (371)..(371): a, c, t, g, unknown or other
  modified_base (422)..(422): a, c, t, g, unknown or other
  modified_base (424)..(424): a, c, t, g, unknown or other
  modified_base (435)..(435): a, c, t, g, unknown or other
  modified_base (445)..(445): a, c, t, g, unknown or other
  modified_base (462)..(462): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctccctgtctgcatctatagganacagaatcaccatcacttgccgggcagtcgagacattagcatgtatccgtaattggtatcaagacaaaaaaccgagggacaacgcccctaaaactcctagactcctcgatgcactccaacgtttaggaaaccgtaggggtaccccatacccgtaaaggttcaggtggaagtggctcgngggactagtattttacttcacctatcagcaggctgcagcctagaagcagtnanaacatagtacngtacatagtntagatacgtcctaccgntaccgtacggttcggggacgggggttaaccaaaggggttcggaagtacgtaacgaaacggaaccgaaacgttggcgggactacggacctacgtaac

SEQ ID NO: 365445 - DNA, 817 bp, Homo sapiens
  misc_feature: GZ8MTXP02GRJYJ.51.67.G01.1.454.CMB.2.raw
  modified_base (193)..(193): a, c, t, g, unknown or other
  modified_base (274)..(274): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctagtagganacagatccacatcatggcggcagtcgagactattagcagtgtatctagaaagttggtaatacgaagtaaaccaaaaacggngggaaccaaccgtaccccctaaaacgtccctaggtaccttcccgtacgtagttcgacctacgttaccgttaacgtttaacgggaaaacgtaccggggttacctaacgttaccggtaacgttacgaaagggttacgggtaaacggttcggtaccgttaccgggtaggggtaaacctttaacgggtttaacccttttttaaaccgtttaccgaaaccctaagttaccgtaaacgtaccgggaacggttcgtaccgggactacccggttacccgtaaaggaactaaccgtagtttacggaaaccctaaaagtttaacttaacgttaaccttaagggtaacaaaaccgttaggggtaacttaacggaacctttaacgtcccccggttaccgtaccgggtttaccgttacccggggggtttaaccgggggaaaccccggggttaaacgggaaacgggtttacgggaaaacgtacccggttaaaggtaaaaccggacggttaaaaccggttcgggacccggtttaacaacccgggtacttaaacccggg

SEQ ID NO: 365446 - DNA, 667 bp, Homo sapiens
  misc_feature: GZ8MTXP02GX6SO.51.67.G01.1.454.CMB.2.raw
  modified_base (192)..(192): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctagtagganacagaatcaccatcacgttggccgggcgagtcgagactattagcatgtatctgaattggtatcagacaaaaccgaggaccacgacccctaaacgtcctagactcctcgatcgactactcctaacgtttaggaaacgtcggggtccaacgtacgtaaggttcgaggtagggaagttcgggcttcggtaggggtacctaagtttacttttaactttccaacctacgttacgagtacacgggtctgacgtacgtaccgttaagggaactaccgtagtttagaaccctaaatacgtttaaattacgttacggtactaaaacgtagttatacggtaacttaacggtccctaaccgtcttaccggttaccgggtttacgggggacccgggggttaaacgtaaacgggggttagaaacgggtacttaccggaaacgtaccggtaaagttacgggtacgggttccacggtaacccttaaccgg

SEQ ID NO: 365447 - DNA, 577 bp, Homo sapiens
  misc_feature: GZ8MTXP02H8KGC.51.67.G01.1.454.CMB.2.raw
  modified_base (217)..(217): a, c, t, g, unknown or other
  modified_base (268)..(268): a, c, t, g, unknown or other
  modified_base (433)..(433): a, c, t, g, unknown or other
  modified_base (437)..(437): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgcatctataggagacagaactcaccatcacttgccgggngagtcgagacattagcatgtatctagtaattggtatcagaccaaaaaccgngggaccacgacccctaaactcctagactccgtgatcgactacttccgtaacgtttacggaaaccgtcggggtcccagtacgaaggttcaggtaggtaagtcggctcgtaggggacctagttacttttacttcactactcacgacaggtctgacacgtctaggaanactnttacgactaatacttattactgtaacagtagtatcgtaatcgtctacccgtcgttacgtacggttcgggggacgggggtaaacccaggggtcgaacgacgtacgaaggtcgtaacgttggacggtacctacgacctaccg

SEQ ID NO: 365448 - DNA, 701 bp, Homo sapiens
  misc_feature: GZ8MTXP02HOKR8.51.67.G01.1.454.CMB.2.raw
  modified_base (192)..(192): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatccctcctgtctgcatctatagganacagaatcaccatcacgttgccgggcagtcgagactattagctatgtatcgtagtaattggtatcaagaaccaaaaaccgagggaaccaacgtaccccctaaaacttcctagactcccgtcgactcgactaacttccgtaacgtttaacgggaaaaccgtcggggtacccacgttaccgtaaaggttacaagggttaggaacggttcgcgttcggtaggtaacgtagtttaaccttttactttacctaaccctaaattccgaaggtaccaacggggtcctcgtacgacgtacccgttaaggaaacgaccttaggttaagacccctaaaacttaatttaaacctttaaccgtacggttaaacccaaacggttataaggttactaacgttaccgtcctccctacgttacgttaccggggtttaccggggacgggggtacctaaacgggtcggtaaagtacttaacggaacgtaccgtaaaggttcggaaccgtcgttacggaccctaaccg

SEQ ID NO: 365449 - DNA, 627 bp, Homo sapiens
  misc_feature: GZ8MTXP02FXJE1.51.67.G01.1.454.CMB.2.raw
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagactattagcatgtatctagaattggtatacagaacaaaaacgacgggaacacgacccctaaactcctagactcctgatgcactcctacgtttacggaaacgacggggtaccagtacgtaaggtcaggtaggaagtcgggtctcgtagggtaacgtaggttactttttactttacctaaaccctagttaccgaagacgaagggtctcggacaacgtcctaaggaacgacagttacactaaactattaattacttacgtactaaactagttaattgaaacgttcgtccttcccgacgttaccggttacggtttacgggggaccggggggtttaacgaacggggtacggtaagacgttaaccgaaggtaccggtaaagttcggtcgggactaccgacgtaaccc

SEQ ID NO: 365450 - DNA, 619 bp, Homo sapiens
  misc_feature: GZ8MTXP02GR86A.51.67.G01.1.454.CMB.2.raw
  modified_base (221)..(221): a, c, t, g, unknown or other
  modified_base (426)..(426): a, c, t, g, unknown or other
  modified_base (435)..(435): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggcttctcaggtgccagatgtgtcatccagatgacccagtcctccatccctccctgtctgcatctataggagacagaatcaccatcacttggccgggngagtcgaagacattagcatgtatctgaattggatcagacaaaaaccgagggacacgacccctaaactcctagactcctacgatcgacactcctaacgtttaggaaacgacggggtacccagtacgtaaggttcaaggtggaagtggcgtcgtgggactagttactttactttcaactatcaagcaggctgacacggcctaggaanactattaanaactaaactattacttacgtagtaacaaacgtagttagtagtacttaccgtacccgtacccgtacgttaccggttaccgggtttaccgggggaaccgggggtaaaccgtaaacggggtacggtaacgtaacgtaaccggaaacggtacggtaacggttcggtacggtaccgtacggacctaacg

SEQ ID NO: 365451 - DNA, 717 bp, Homo sapiens
  misc_feature: GZ8MTXP02I8EIV.51.67.G01.1.454.CMB.2.raw
  modified_base (194)..(194): a, c, t, g, unknown or other
  modified_base (223)..(223): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctcctgtctgccatctaagtagganacagaactcaccatcacgttcggccgggngagtcgaagactattagcatgtatctgtaattggtatacaacgaaccaaaaaccgagggaaccaccgacccctaaactcctagactccctgatcgacactcctaacgtttaggaaccgtacgggtcctaataccgtaagttacgaggtaggaagtcggcgtacgtacgggaacttagttaacttttaccgtttacaacctattacgagtacgagggtctacggctaccggacgttaacggaaagtaccgtaagtttaccggaactaaaaccgttaaatttaacttaacttaacggtaacctaaacgttaacgtaagtttacgaacgtttaacccggttccccgtacccccgtacgtttacccggttaaaacccggggtttccggggggaaaccccggggggtaaaccttaaagggggttacggaaaacgttaacggtaaaccggaaacggtacccgtaaaggtcgggtaacggtccgtacgtacccgttaaccg

SEQ ID NO: 365452 - DNA, 608 bp, Homo sapiens
  misc_feature: GZ8MTXP02JNRQL.51.67.G01.1.454.CMB.2.raw
  modified_base (195)..(195): a, c, t, g, unknown or other
  modified_base (478)..(478): a, c, t, g, unknown or other
  modified_base (504)..(504): a, c, t, g, unknown or other
  modified_base (518)..(518): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatcgacccagtctccatccctccctgtctgcatctagtagganacagaatcacctatcacgttacggccgggacgtagtcgagaactagttagactagtgtatctgtaagttaggtatacgaacgaaaccgaaaaaccggacgggaacctaacccgtaacccccttaaactccccgttagaccttcccgtacgtaagtcgactaccgttcctaacggtttaaacggaaccgtacgggtacctaacgtaaccgtaagttacgtaggtaggtaacgtgtcgtacgtagggtactagttactttactaccaacgtactagagacgcgtntcgatacgacgtagtaacgactatanataaactataactntacgataatagatagtataccgtcctacgctacggttaggacgggtaccggagtaggagactagtcaagttcagtagcgtcacgactacg

SEQ ID NO: 365453 - DNA, 471 bp, Homo sapiens
  misc_feature: GZ8MTXP02GXCGA.51.67.G01.1.454.CMB.2.raw
  modified_base (190)..(190): a, c, t, g, unknown or other
  modified_base (215)..(215): a, c, t, g, unknown or other
  modified_base (322)..(322): a, c, t, g, unknown or other
  modified_base (326)..(326): a, c, t, g, unknown or other
  modified_base (351)..(351): a, c, t, g, unknown or other
  modified_base (358)..(359): a, c, t, g, unknown or other
  modified_base (372)..(372): a, c, t, g, unknown or other
  modified_base (374)..(374): a, c, t, g, unknown or other
  modified_base (378)..(378): a, c, t, g, unknown or other
  modified_base (380)..(380): a, c, t, g, unknown or other
  modified_base (382)..(382): a, c, t, g, unknown or other
  modified_base (390)..(390): a, c, t, g, unknown or other
  modified_base (392)..(392): a, c, t, g, unknown or other
  modified_base (394)..(394): a, c, t, g, unknown or other
  modified_base (396)..(396): a, c, t, g, unknown or other
  modified_base (408)..(408): a, c, t, g, unknown or other
tcagcgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctcatcctcctgtctgcatctatagganacagaatcaccatcacttgcccggnagtcgagacattagcatgatctgaattggatcagacaaaactaggacagacccctaaatcctgatctcgatgcatccattgaacagggtccatcagttcagtgaagngctngggactagtatttacttacacgtancagcagnngacacgacgagananatanananatatatananananatagtatatacncgctactacgtcggtacgggacggacggacgagagacgaacgacgacgtacgagacgcacacg

SEQ ID NO: 365454 - DNA, 546 bp, Homo sapiens
  misc_feature: GZ8MTXP01EH4CQ.45.63.F08.1.454.CMB.2.raw
  modified_base (269)..(269): a, c, t, g, unknown or other
  modified_base (509)..(509): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttccccttnaatagctatagcatgaactgggtccgcaggctccgaggggaaggggctggcgtgggtttcagtacattagtactagtagtagtacccatatactacgcaaagactctagtgaaaggggcctattcacatctccaagagacaatgaccaaagaactcaactgtatctagacaaatgaaacagcctagagagacgaggacacggctagaattattacgtgttgacgtagagttattttcggntatccaggccttaagggttcccgaacccggtcggggg

SEQ ID NO: 365455 - DNA, 547 bp, Homo sapiens
  misc_feature: GZ8MTXP01EEON7.45.63.F08.1.454.CMB.2.raw
  modified_base (466)..(466): a, c, t, g, unknown or other
  modified_base (476)..(476): a, c, t, g, unknown or other
  modified_base (490)..(490): a, c, t, g, unknown or other
  modified_base (503)..(503): a, c, t, g, unknown or other
  modified_base (511)..(511): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacaggccgtggggggtccctgagactctcctgtgcagcctctggacttcccccttcaatagctatagcatgaactgggtccgccaggctccgagggaggggctggcgtgggtttcatacattagtactagtagtagtacccatatactacgcaagactcgtgtagaaagggccgattcacctatcctaccagagacaaatgacccaaagaactcacttgtatctgacaaaatgaaacagcctagagagacgngtacacggtntataatattactgngagtagttagttntttcggtntactccgagcgttacgggttcccgaacccggtgggg

SEQ ID NO: 365456 - DNA, 534 bp, Homo sapiens
  misc_feature: GZ8MTXP01BUEYO.45.63.F08.1.454.CMB.2.raw
  modified_base (268)..(268): a, c, t, g, unknown or other
  modified_base (494)..(494): a, c, t, g, unknown or other
  modified_base (505)..(505): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttcccctnaatagctatagcatgaactgggtccgccaggctccgaggggaaggggctggcgtgggtttcatacattagtactagtagtagtaccccatatactacgcaagactctgtgaagggccattcacatctcagagacaatgaccaaagaactcactgtaatctagactaaatgaaacagcctgaagagacgaggacacggctgtaatattactgttgacgagttagttnttttcgaagtntccgagcagggttcccgaaccccgtgggg

SEQ ID NO: 365457 - DNA, 513 bp, Homo sapiens
  misc_feature: GZ8MTXP01DJFHA.45.63.F08.1.454.CMB.2.raw
  modified_base (482)..(482): a, c, t, g, unknown or other
  modified_base (489)..(489): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttgggtacagcctggggggtccctgagactctcctgtgcagcctctggattccccttcaatagctatagcatgaactgggtccgcaggctccagggaaggggctggcgtgggtttcatacattagtactagtagtagtaccccatatactacgcaagactctgtgaagggccgattcaccatctccagagacaatgccaagaactcactgtatctgcaaatgaaacagcctgagaggacgaggacacggctgtaatattactgttgcgagagnttttcgngtatcagcaggtcgcccgtcgggg

SEQ ID NO: 365458 - DNA, 689 bp, Homo sapiens
  misc_feature: GZ8MTXP01C6VX5.45.63.F08.1.454.CMB.2.raw
  modified_base (275)..(275): a, c, t, g, unknown or other
  modified_base (280)..(280): a, c, t, g, unknown or other
  modified_base (518)..(518): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttgggtacaggccgtggggggtccctgagactctcctgtgcagcctctggacttccccccttanaatanctatagcagtacgaacgtcgggccgcgaggccgtacggaaggggacggggcgtgggtcggttgggttacaagttactaagtttagtacgtagtagtacgtaacccattactacgtacgctaaagtactcgtaggtacgggaaacgggtcctattaccaacctactcctaccgaagaacgaacaatacgaacaaacgtaacctacaacttagtactacgtagaacgtaaatacgaaacncgtaccgtaaggaaggaacggaaacggaacggtaaccgacgggtacttaaggttaaattaacgtttacgtgggttacggtaacggtaaggttaacgtttcgtttttacgggtaagttaactcccggtaaggtccggttaaccgggtttccccggaaccccggggtcggggg

SEQ ID NO: 365459 - DNA, 585 bp, Homo sapiens
  misc_feature: GZ8MTXP01AQJ4A.45.63.F08.1.454.CMB.2.raw
  modified_base (529)..(529): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctatttagaaggtgtccagtgtgaggtgcagctggtggagtcgtgggggaggcttggtacagccgtgggggtccctgagactctcctgtgcagcctctggacttccccttcaatagctatagcatgaactgggtccgcaggctccgagggaaggggctggcgtgggtttcatacattagtactagtagtagtacccatatactacgcaagactcgtgtggaagggcccgattcacatctcagagacaatgaccaagactcactgtaatctagactaaatcgaacacgtcctagacgaaggaaccggaacggaactaccgggcttggtaattacgttaacgtggttggacggtaaggttacgttagtttttcgnggttactcccgtaaggtcccgttaacggggttcccgttaaccccgggtccgggggg

SEQ ID NO: 365460 - DNA, 544 bp, Homo sapiens
  misc_feature: GZ8MTXP01AU6XQ.45.63.F08.1.454.CMB.2.raw
  modified_base (272)..(272): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttgggtacaggccgtggggggtccctgagactctcctgtgcagcctctggacttccccttnaatagctatagcatgaactgggtccgccaggctccgagggaggggctggcgtgggtttcatacattagtactagtagtagtacccatatactacgcaagactcgtgtaggaacgggccgattcacatctccagagacaatgaccaaagaactcactgtatctagacaaatgaacagcctgagagacgaggacacggctgtaatagttactgttgacgagttagttattttcgaattatccaggcgttacgggttcccgaacccggtcggggg

SEQ ID NO: 365461 - DNA, 573 bp, Homo sapiens
  misc_feature: GZ8MTXP01EHYV7.45.63.F08.1.454.CMB.2.raw
  modified_base (271)..(271): a, c, t, g, unknown or other
  modified_base (451)..(451): a, c, t, g, unknown or other
  modified_base (533)..(533): a, c, t, g, unknown or other
  modified_base (540)..(540): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgcttgggttttccttgttgcttattttagaaggtgtccagtgtgaggtgcagctgggtggagtcgtgggggaggcttggtacaggccggtgggggtccctgagactctctgtgcagcctctgacttccccctanaatagctatagctatgaacgtgggtcccgccgaggcctcggagggaggggctgggcgttgggtttacattactagttagtactagtagtacgtaccccatatactacgcaagactcgtgtaggaacgggcctattcactatcctacagagacaatgaccaaagaacctcgactagtactntagacaaaatcgaaacagtccgaggacgagaacggacgaccgacggtctagtaattacgttagtgttagacgtagttagttntttcgtntatccgagcgttacggtccgaacccggtcgggg

SEQ ID NO: 365462 - DNA, 540 bp, Homo sapiens
  misc_feature: GZ8MTXP01CHZGT.45.63.F08.1.454.CMB.2.raw
  modified_base (293)..(293): a, c, t, g, unknown or other
  modified_base (477)..(477): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggtttccttgttgctatttagaggtgtccagtgtgaggtgcagctggtggagtcgtgggggaggcttggtacagccgtggggggtccctgagactctcctgtgcagcctctggacttccccttcaatagctatagcatgaacgtgggtccnccaggctccgaggggagggctggcgtgggtttcatacattagtactagtagtagtaccccatatactacgcaagactcgtgtagaagggccattcaccatcctaccagagacaatgaccaaagaactcactgtaatctagacaaatgaacagcctgacgagacgagccaggctgtaatattacnggttcgacgtagagttcttttcggtgtatccgaagcgttacgggttccgaaccccggtggggg

SEQ ID NO: 365463 - DNA, 533 bp, Homo sapiens
  misc_feature: GZ8MTXP01AUILH.45.63.F08.1.454.CMB.2.raw
  modified_base (267)..(267): a, c, t, g, unknown or other
  modified_base (398)..(398): a, c, t, g, unknown or other
  modified_base (472)..(472): a, c, t, g, unknown or other
  modified_base (495)..(495): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtgggggtccctgagactctcctgtgcagcctctggacttcccctnaatagctatagcatgaactgggtccgccaggctccgagggaggggctgggcgtgggtttcatacattagtactagtagtagtacccatatactacgcaagactctgtgaagggccgattcacatctcaganacaatgaccaaagactcactgtatctgacaaatgaaacagcctagagagacgaggacaggctgtaatagttacnggttgcggtagagttgttttcgngtactccgagtcgttacgggttccgaaccccgtggggg

SEQ ID NO: 365464 - DNA, 699 bp, Homo sapiens
  misc_feature: GZ8MTXP01DVR52.45.63.F08.1.454.CMB.2.raw
  modified_base (270)..(270): a, c, t, g, unknown or other
  modified_base (275)..(275): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctcctgtgcagcctctggacttcccccttanaatanctatagcatagacgtcggccgcgaggcgtacggaggggagggcgtggtcgttggttacatactagttagtacgtagtagtacgtaccctatatactacgcaagtactcgtggtaggaacgggtcctattaccactactctacgagaacaacaagtcgaaccaaacgtaacctacaacgttagtactacgtagaaactaaaagtacgaaacctacggaccgtaaggaaacggaacggaaaccgggaacgggtaacccgtaacgggtacgttaaggttaaactttaacgtttaaccggttgggttacgggtaacggttaaaggttaacggttttacgtttttaccgggtaaggttaccgttaacccggtaacgggtacccgggttaacccgggtttaacccccgggttaacccccggggtcggggg

SEQ ID NO: 365465 - DNA, 533 bp, Homo sapiens
  misc_feature: GZ8MTXP01ATVCF.45.63.F08.1.454.CMB.2.raw
  modified_base (468)..(468): a, c, t, g, unknown or other
  modified_base (479)..(479): a, c, t, g, unknown or other
  modified_base (496)..(496): a, c, t, g, unknown or other
  modified_base (502)..(502): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacaggccgtggggggtccctgagactctcctgtgcagcctctggacttcccccttcaatagctatagcatgaactgggtccgcaggctccgagggaggggctggcgtgggtttcatacattagtactagtagtagtaccccatatactacgcaagactctgtaggaagggccattcaccatctccagagacaaatgaccaaagactcactgtatctgacaaatgaaacagcctgagagacgagacgacggtntagtaatattntgttcgagagttagttntttgtntactccgagcgttacggtcccgccggtcggg

SEQ ID NO: 365466 - DNA, 575 bp, Homo sapiens
  misc_feature: GZ8MTXP01DGOAS.45.63.F08.1.454.CMB.2.raw
  modified_base (374)..(374): a, c, t, g, unknown or other
  modified_base (456)..(456): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagttcgtgggggagcttggtacaggccgtgggggtccctgagactctcctgtgcagcctctggacttcccctcaatagctatagcatgaacgtgggtcccgccaggcctccgaggggaagggggctggcggttgggtttcatactattagtactagtagtagtaccccatatacgtacncaagactctgtaggaacgggtccgtattcactatcctccagagacaatgaccaagactcacttgtatctgacaaatgaaacncgctagagacgacggaggacacggtctagtaattattacgtgttagcggtaagaggtttattttcggtaagttactcccgtaaggccgttacggggtttcccgccccgggttaaggggg

SEQ ID NO: 365467 - DNA, 684 bp, Homo sapiens
  misc_feature: GZ8MTXP01CJIVK.45.63.F08.1.454.CMB.2.raw
  modified_base (270)..(270): a, c, t, g, unknown or other
  modified_base (275)..(275): a, c, t, g, unknown or other
  modified_base (279)..(279): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacaggccgtgggggtccctgagactctcctgtgcagcctctggacttcccccttanaatanctanagcatagacgtcggccgcgaggctacggagggacgggcgtggtcgttggttacatactattagtactagtagtacgtaccctatatactacgacaacgtactgtaggtacgggaacgggtcctactaccactactcctacgaagacaacaagtacgaaccaaacgtaacctactaacgttagtaactacgtacgaaacgtaaaacgtacgaaaccacgtaccgtaaggaaacggtaacggaaaccggtaacggtaaaccgtacggtacgttaaggttaaactttaacgttacggttggttacggtaacggttaaggttacgtttacgttttacggtaagttaacctaacccggtacggtacccggttaaccggggttaaccccggttaaccccgggtaacggggg

SEQ ID NO: 365468 - DNA, 560 bp, Homo sapiens
  misc_feature: GZ8MTXP01D5K6A.45.63.F08.1.454.CMB.2.raw
  modified_base (269)..(269): a, c, t, g, unknown or other
  modified_base (453)..(453): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctcctgtgcagcctctggacttcccccttnaatagctatagcatgaacgtgggtcccgccaggcctccgagggaggggctggcgtgggtttcatacattagtactagtagtagtacccatatactacgcaagactcgtgtagaaacgggcctattcaccatcctacagagacaatcgaccaaagaactcacttgtatctagactaaatgaaacngcctagagagaacgaggacacggtctgtaattgttactggttgacggaagttagttgttttcgtgttatccgaggccgttacgggtttcccgaacccgggtcggggg

SEQ ID NO: 365469 - DNA, 519 bp, Homo sapiens
  misc_feature: GZ8MTXP01AOXOE.45.63.F08.1.454.CMB.2.raw
  modified_base (297)..(297): a, c, t, g, unknown or other
  modified_base (468)..(468): a, c, t, g, unknown or other
  modified_base (473)..(473): a, c, t, g, unknown or other
  modified_base (482)..(482): a, c, t, g, unknown or other
  modified_base (484)..(484): a, c, t, g, unknown or other
  modified_base (491)..(491): a, c, t, g, unknown or other
  modified_base (497)..(497): a, c, t, g, unknown or other
  modified_base (500)..(500): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacaggccgtggggggtccctgagactctcctgtgcagcctctggacttccccttcaatagctatagcatgaactgggtccnccaggctccgagggaaggggctggcgtgggtttcatacattagtactagtagtagtaccccatatactacgcaagactctgtgaagggccattcaccatctcagagacaatgccaaagactcactgtatctgacaaatgaacagcctgagagacgagctacggctgtaatnttacngttgcgagngnttttcgngttacncgngcgacggtccgccggtggg

SEQ ID NO: 365470 - DNA, 671 bp, Homo sapiens
  misc_feature: GZ8MTXP01C2RGM.45.63.F08.1.454.CMB.2.raw
  modified_base (273)..(273): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtggggggagcgttggtacaggccgtggggggtccctgagactctcctgtgcagcctctggacttccccttnaatagctatagcatagaacgtcgggtcccgcaggctccggaggggagggggctgggcggttgggtttacatactagttagtactagtagtacgtacccatatactacgcaagactcgtgtagggaacgggtccgattccaacctactcctaccgaagaacgaacaagtacgaaccaaacgtaaccttacaacgttagtaactacgtagaactaaaagtacgaaacgacggtacctaggaaacggacggaaaccggaagggtaaccgacgggtacttaaggttaatttaagttacgtggttaggacgggtaagttaacggtttgtttttacggtcggttaacttcccgtaacgggtccggttaaccggggtttccccggaacccccggggttccggggg

SEQ ID NO: 365471 - DNA, 560 bp, Homo sapiens
  misc_feature: GZ8MTXP01CVTJI.45.63.F08.1.454.CMB.2.raw
  modified_base (270)..(270): a, c, t, g, unknown or other
  modified_base (296)..(296): a, c, t, g, unknown or other
  modified_base (455)..(455): a, c, t, g, unknown or other
  modified_base (472)..(472): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgctattttagaaggtgtccagtgtgaggtgcagctggtggagtcgtgggggagcttggtacagccgtggggggtccctgagactctcctgtgcagcctctggacttcccccttnaatagctatagcatgaactgggtccncagctccgagggagggctggcgtgggttcatacattagtactaagtagtacgtacccatatactacgcaaagacctgtgtagaaggggccctattccaccatcctacagaagacaatcgaccaaagaactcaactgtaatcagtacaaaatggaaaccngacctagagagaacggngaacgcgtatgtaactattacgtgttggacgtagaagtttgtttacgtgtactccgaagcggttacggtcccggaaccccgtcggggg

SEQ ID NO: 365472 - DNA, 590 bp, Homo sapiens
  misc_feature: GZ8MTXP01EKG1R.45.63.F08.1.454.CMB.2.raw
  modified_base (270)..(270): a, c, t, g, unknown or other
  modified_base (385)..(385): a, c, t, g, unknown or other
  modified_base (508)..(508): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggagcttggtacaggccgtgggggtccctgagactctcctgtgcagcctctggactttcccccttanaatagctatagctagtcgaacgtcgggtcccgcgaggcctaccggaggggagggggctggtcgttgggtttacattacattagtactagtagtagtaccccatatactacgcaanactcgtgtaggaacgggcctattcacatctacgagagacaatcgaaccaagtactcacttagtactctagaactaaagtacgaaacacgacctaggaagaacggaacggaggaccgtacggtnttagtaactattacgtggttgaggtaagttagttcttttcgtgtatccgagtaccgttacggttcccgcccgggtaacgggg

SEQ ID NO: 365473 - DNA, 610 bp, Homo sapiens
  misc_feature: GZ8MTXP01DS2IL.45.63.F08.1.454.CMB.2.raw
  modified_base (267)..(267): a, c, t, g, unknown or other
  modified_base (270)..(270): a, c, t, g, unknown or other
  modified_base (273)..(275): a, c, t, g, unknown or other
  modified_base (288)..(288): a, c, t, g, unknown or other
  modified_base (522)..(522): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtgggggtccctgagactctcctgtgcagcctctgacttccccttanatncannnatgacgtcggccncgagctacggagggagggctggtcgttggttacatactattagtactagtagtactacccatatacacgacaagtactgtagtacggaacgggctatccactactcacgagaacgaacaatacgtacaaacgtaactacaactagtactacgtaagaacgtaaagtacgaaacacgtaccgtaaggaacgacggaacggacggtaacgacgtactaagttaactaacgttacgngttacgacggtaagttacgtttcttttacggtaagtacctaaccgtaagtaccggttacgggttaaccccggaaccccggggtcgggg

SEQ ID NO: 365474 - DNA, 561 bp, Homo sapiens
  misc_feature: GZ8MTXP01AC74U.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacagccgtgggggggtccctgagactctcctgtgcagcctctggacttcccctcaatagctatagcatgaacgtgggtccgccaggctccgaggggagggctggcgtgggttcatacattagtactagtagtagtacccatatactacgcaagactctgtagaagggcctatcacatctacagagacaatcgaccaaagaactcactgtatcctagaactaaatagaaacacgaccagacggaacgaacggaggtaccgacgggtcttaggtaattaattacgtgttggacgaagttagttatttcgtgtactccgagcgttacggttccgaaccccggtcgggg

SEQ ID NO: 365475 - DNA, 565 bp, Homo sapiens
  misc_feature: GZ8MTXP01D6MQN.45.63.F08.1.454.CMB.2.raw
  modified_base (301)..(301): a, c, t, g, unknown or other
  modified_base (384)..(384): a, c, t, g, unknown or other
  modified_base (516)..(516): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctgggtggagtcgtgggggagcttgggtacaggccgtggggggtccctgagactctcctgtgcagcctctgacttccccttcaatagctatagctatagaactgggtcccnccgaggcctccgaggggaagggggcgtgggcgttgggtttcattacatttagtactagtagtagtacccatatactacgcaanactctagtcgaaacggggcctattccacctatctccaagacgacaatcgaccaagaactcactgtatctagacaaatcgaacagcctagagagacgagacagtctgtaatattatgttgcgtaagttagttnttttcgtgttactcgacgcgttacgggttcccgaaccccggtccggggg

SEQ ID NO: 365476 - DNA, 533 bp, Homo sapiens
  misc_feature: GZ8MTXP01CZOGQ.45.63.F08.1.454.CMB.2.raw
  modified_base (270)..(270): a, c, t, g, unknown or other
  modified_base (296)..(296): a, c, t, g, unknown or other
  modified_base (463)..(463): a, c, t, g, unknown or other
  modified_base (490)..(490): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttcccccttnaatagctatagcatgaactgggtccncaggctccgagggagggctggcgtgggttcatacattagtactagtagtagtacccatatactacgcaagactcgtgtagaagggccattcacatctcagagacaatcgacaaagactcactgtatctagactaaatgaaacagcctagacgagaacgagacacggntgtaatattactgcgtgagttaagttntttcgaagtatccgagtcgttagggttcccgaacccgtcgggg

SEQ ID NO: 365477 - DNA, 659 bp, Homo sapiens
  misc_feature: GZ8MTXP01AKT0X.45.63.F08.1.454.CMB.2.raw
tcagacgcgatcgacacgaccggtgctcgatttagcgatcgtataagggggaatcagtcccactcaggacacagcatggacatggagggtccccgctcagctcctggggctcctgctgctctggttcccaggtgccaggtgtgacatccagatgacccagtctccatctgccatgtctgcatctgtaggagacacagtcaccatcacttggtcgggcgagtcgaggggcatttagctaattattagccttggttcagacaagaaaccgagggaaacgtcccctaaagccgcctagactctatgctgactattcccgtaggtttcgacgtaaacggtcggggtacccaagtaccccgtaaagggttcgaggtaccggcgtaaagggtcggaagtcgtaggggactagtaccgttcacttctacaacaactcacgcacgcccgtagccagacccgtagtaaacgttagtttacgacctttaaactttactttaccgttacgttacctacctaacgtacctaattaacgttaccggttaacccgttacgttaacgggttttcggacccggagggggtaacccaagggtaccgttaagggaagttacgttaaccgaaaccgtaacgttcggtacgggacttacggtaacccgaacccgttaag

SEQ ID NO: 365478 - DNA, 637 bp, Homo sapiens
  misc_feature: GZ8MTXP01EA3ZK.45.63.F08.1.454.CMB.2.raw
  modified_base (268)..(268): a, c, t, g, unknown or other
  modified_base (272)..(272): a, c, t, g, unknown or other
  modified_base (276)..(276): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttcctgttgctattttagaaggtgtccagtgtgaggtgcagctggtggagtcgtgggggagcttggtacaggccgtggggggtccctgagactctcctgtgcagcctctggacttcccctanatanctanagcagtacgacgtcggccgacgaggcgtacggaggggacgggtcgtgggtcggttggttacaagttactagttagtactagtagtacgtaaccatactacgtacgcaacgtactcgtaggtacggaacgggtcctacttaccaactactacctacgaagaacgaactaacgtacgaaaccaaagtaacctacgaacttagtaactacgtacgaaacgtaaagtagaaacgacgacgtaagaaggaacggaacggtacggaacgtacgtacttagtaattaagttacgtggttacgaggtaagttagtttcgtttacggaagtactcgacgtcggttaccggttcccggaacccgggtcggg

SEQ ID NO: 365479 - DNA, 626 bp, Homo sapiens
  misc_feature: GZ8MTXP01D280I.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctctgtgcagcctctggacttccccttcaatagctatagctatgaacgtcgggtcccgccgtaggcctccggaaggggaagggggctgggcgtgggtttcatactattagtactagtagtacgtacccatatactacgcaagactcgtgtaggaaacgggccgtattaccactactcctaccaaggacaactaatcggaacccaaagaaaccttcaaactgtaaactcgtacgaacgaaaatcgggaaaaactcggaccctaaggaaggacggtaaacgggacgtaaccgaacggtcgttagttaattattacgtggttcgagtagttagtttagtttcggaattactccgtaggtcgttacggtccccggttaacccggtccgggg

SEQ ID NO: 365480 - DNA, 552 bp, Homo sapiens
  misc_feature: GZ8MTXP01DZF4Y.45.63.F08.1.454.CMB.2.raw
  modified_base (267)..(267): a, c, t, g, unknown or other
  modified_base (294)..(294): a, c, t, g, unknown or other
  modified_base (401)..(401): a, c, t, g, unknown or other
  modified_base (500)..(500): a, c, t, g, unknown or other
  modified_base (508)..(508): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtgggggtccctgagactctcctgtgcagcctctggacttccccctnaatagctatagcatgaacgtgggtccncaggctccgaggggagggctggcgttgggttcatacattagtactagtagtacgtacccatatactacgcaagactcgtgtagaaagggcctatcacatctacaganacaatgaccaaagactcacttgacttcagacaaatgaaacaggccagagagaaacggaggaccacggctgtaattattacgtgttgaggtagttagttnttttcggngtaactccgaagtcgacgggtttcccggaaccccggttcggggg

SEQ ID NO: 365481 - DNA, 603 bp, Homo sapiens
  misc_feature: GZ8MTXP01A79IR.45.63.F08.1.454.CMB.2.raw
  modified_base (307)..(307): a, c, t, g, unknown or other
  modified_base (465)..(465): a, c, t, g, unknown or other
  modified_base (497)..(497): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagcgtgggtggagtcggtgggggagtcgttggtacaggccgtggggggtccctgacgactctcctgtgcagcctctggtacttcccctacaatagctatagcatgaacgtcgggtcccncgaggcctaccggaggggaggggctgggcgttgggttacatacgtagtttagtactagtagtacgtaacccatatactacgacaagtactcgtgtagggaacgggcctattccactactctacgaagagaacaagtcgaaaccaagaactcaacgttntaatcgtacgaactaaatacgaaacacgaccngaagacgaacggacgtaacgacggtacttgtaattacgttagtggttgacgtagttagttgtttcgaatactcgagtcgttaacggttcccgaaccggtaacgggg

SEQ ID NO: 365482 - DNA, 687 bp, Homo sapiens
  misc_feature: GZ8MTXP01EHV1I.45.63.F08.1.454.CMB.2.raw
  modified_base (274)..(274): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggactttccccccgttanaatagactatagctagtacggtaacgtcgggtcccgccgacggccgtaccgggaagggggaacgggggtcgttcggggtcgggtttggggttttacaacgttaacttaagtttagttaacgtaagttaagtacgtaaccctatactactacgcaaacgtacttgtaggtacgggaacgggctactaccactactcacgagaacgaacaagtacgaacaaacgtaactcacttagtatacgtagaacgtaaatcgaaacgacgacgaggaacgaacggaacggacggtaacgtacggtcttaagtaacttaagttacgtaggttcgacggtaagttacgtttacgttttcggtaacgttacgtccggtaacggtccggttaccgggttaaccccggaaccccggggtaacgggg

SEQ ID NO: 365483 - DNA, 582 bp, Homo sapiens
  misc_feature: GZ8MTXP01DTD86.45.63.F08.1.454.CMB.2.raw
  modified_base (538)..(538): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttccccttacaatagctatagcagtgaacgtcgggtcccgccaggcctccggaggggaggggcgtggcgttgggtttcattacattagtactagtagtagtaccccatatactacgcaagactcgtggtaggaaacgggccgtattccacctactcctaccaggacgaacaatcgaccaaacgaacctcactgtaatctacgaacaaatagaaacacgtccgtagagacgaacggaggaccacggctgtaacttagttactgttgacgtagttagttnttttcgtgtactccgagtcgttacgggttcccgcccggtcgggg

SEQ ID NO: 365484 - DNA, 563 bp, Homo sapiens
  misc_feature: GZ8MTXP01DPZ6S.45.63.F08.1.454.CMB.2.raw
  modified_base (278)..(278): a, c, t, g, unknown or other
  modified_base (510)..(510): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtgggggagtcttggtacagccggtggggggtccctgagacctctcctgtgcacgtcctctggactttcccccttanaatagctatagcatgaacgtggtcccgcaggctccgaggggagggctggcgtgggtttcatacattagtactagtagtacgtacccatatactacgcaagactcgtgtagaacgggccattcacatctacagagacaatgaccaaagaactcactgtatactgaacaaatagaacagtcagagagacggagacgacggtctagtaatacttacgtgttgacggtagagtttnttttcgaagtaactccgagacgttacgggttccccgaacccggtaaccggggg

SEQ ID NO: 365485 - DNA, 578 bp, Homo sapiens
  misc_feature: GZ8MTXP01C9TK0.45.63.F08.1.454.CMB.2.raw
  modified_base (268)..(268): a, c, t, g, unknown or other
  modified_base (298)..(298): a, c, t, g, unknown or other
  modified_base (476)..(476): a, c, t, g, unknown or other
  modified_base (549)..(549): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgctattttagaaggtgtccagtgtgaggtgcagctggtggagtcgtgggggagcttggtacaggccgtgggggtccctgagactctctgtgcagcctctggacttcccctanaatagctatagcagtgaacgtcgggtcccncgaggcctccggaaggggaggggctgggcgttgggtttacatactagttagtactagtagtagtacccatatactacgcaacgtactcgtgtaggaacgggtcctattcacctatcctaccgaagtacgaacaatacgaaccaaagtaactcactagtactactagaacaaatgaacngacctagagagaacgagacacggtctgtaactagttacgtgttagacgtagttagttagttttcgaagttacncgtagcgttacggtcccgcccggtcgggg

SEQ ID NO: 365486 - DNA, 559 bp, Homo sapiens
  misc_feature: GZ8MTXP01EO7M2.45.63.F08.1.454.CMB.2.raw
  modified_base (272)..(272): a, c, t, g, unknown or other
  modified_base (492)..(492): a, c, t, g, unknown or other
  modified_base (518)..(518): a, c, t, g, unknown or other
  modified_base (524)..(524): a, c, t, g, unknown or other
  modified_base (531)..(531): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggaggtcgtgggggaggcttggtacaggccgtggggggtccctgagactctcctgtgcagcctctggacttcccccttnaatagctatagcatgaacgtgggtcccgcaggctccgagggaaggggctgggcgttgggttcatacattagtactagtagtagtaccccatatactacgcaaagactcgtgtaggaacgggcctagttcacctatcctaccaaggacaacaatgacccaaagaacctcacttgtatctagaacaaatcgaaacagtccagacgagacgaggtacacggtntataatattgtgagagtagttagttntttcgntactcgngtacgttacggttcccgaacccggtggg

SEQ ID NO: 365487 - DNA, 703 bp, Homo sapiens
  misc_feature: GZ8MTXP01DA38F.45.63.F08.1.454.CMB.2.raw
  modified_base (408)..(408): a, c, t, g, unknown or other
tcagacgcgatcgacacgaccggtgctcgatttagcgatcgtataagggggaatcagtcccactcaggacacagcatggacatgagggtccccgctcagctcctggggctcctgctgctctggttcccaggtgccaggtgtgacatccagatgacccagtctccatctgccatgtctgcatctgtaggagacacagtcacatctacgttggtcgggcgagtcgagggctattagactaaatttattagccttggttacagacaacgaaaccgaagggaaacgtccctaagcgtcctagatctatgctgcatcctagttgactaaacgggtcggtacccatacccgtaaggttcgaggtcggactaagggtggaagtcgtacggggaactagtacctcactctactaanaacgtcgacgacgaacgtccgtacgacgacgtcccgttaaggtaaagttaacgttttaccgaacgtttaaaactttacgtttaaaccttcggttaaccttaaaccgtacggtaacttaaaactttaaaccgtttaccgtttaaacccggttacgtttacgggtttttaacccgggacccgggttaaacgggggaaaccccgttaaggtaccggtaggttaaacgttacgttaaaaccggaaaacccggttaaacgtgggttaccgggacttacggtcccgttaacgtttaacccg

SEQ ID NO: 365488 - DNA, 565 bp, Homo sapiens
  misc_feature: GZ8MTXP01B97LX.45.63.F08.1.454.CMB.2.raw
  modified_base (272)..(272): a, c, t, g, unknown or other
  modified_base (368)..(368): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtgggggagcgttgggtacaggccgtggggggtccctgagactctcctgtgcagcctctggacttcccctnaatagctatagcatgaacgtggtccgccaggcctccgagggagggctggcgtgggtttcatacattagtactagtagtagtacccatatactacgnaagactctgtagaagggccgattcacatctacagacgacaatgaccaaagaactcactgtatctagacaaatgaaaccagtacctgaagacgaacggacggaacacggtctgtaatactttctggttcgacgagttaggttacttttcggtaagttactcgtacgtcgttacggttcccgaaccccggtaacggggg

SEQ ID NO: 365489 - DNA, 815 bp, Homo sapiens
  misc_feature: GZ8MTXP01EC94H.45.63.F08.1.454.CMB.2.raw
  modified_base (217)..(217): a, c, t, g, unknown or other
  modified_base (246)..(246): a, c, t, g, unknown or other
  modified_base (267)..(267): a, c, t, g, unknown or other
  modified_base (295)..(295): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgctattttagaaggtgtcagtgtgaggtgcagctggtggagtcgtgggggagcttggtacngccgtggggggtccctgagactctctgtncagcctctggacttcccctanaatagctatagcatgaacgtcgggtccnccgaggccgtaccggaggggtaacggggcgttggggcggttggggtttacattaacgtagtttaacggtacttaaggtaagttaacggttaacccccaattaactaacgtaccggctaaaacggtacttcggttaggtaggggtaaaccgggtcccgtaactttacccaacctaacttaccctaccgaaggaacggaaacaaacgttacggaaacccctaaaagtaacctacctaaccgttaggttaaacttacccgtaagggtaaccctaaaaaagttaccgggtaaaaccgtaacgggtacccgtaaaggggaaaggaaaccggtaaaacgggggtaaaccggggaaacccgtaacgggttaccgttaagggtttaaatttaagtttaccggtagggtttacggaacgggttaaggttaacggttttaagttttttaccgggtaaggtttacctaaccggtaaacggtccggtttaaaccgggggttccccggttaaccccgggggtaacccgggggg

SEQ ID NO: 365490 - DNA, 655 bp, Homo sapiens
  misc_feature: GZ8MTXP01EDLZ9.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtgggggtccctgagactctcctgtgcagcctctggtacttcccctacaatagctatagcatacgaacgtcgggtcccgccgaggcctaccggaagggggaacggggcgtggggtcggttggggtttacaattaacgtaagtttagtactaagtagtacgtaacccatatactacgctaaagtactcgtaggtaggaaacgggcctaattccgaacctactcctaccgaagacgaactaaagtcgaacccaaagtaacctcaacttgtaactcgtagaactaaaagtacggaaacacgacccgtaggaacggaacgaacgggaacggaaccgtacgggtcttaggtaattaacgttacgtggttgacgtaggttacgtttgtttccgtaatactccgagtccggttacgggttccccgaaccccggtaacggggg

SEQ ID NO: 365491 - DNA, 683 bp, Homo sapiens
  misc_feature: GZ8MTXP01CMJB1.45.63.F08.1.454.CMB.2.raw
  modified_base (300)..(300): a, c, t, g, unknown or other
  modified_base (418)..(418): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagcgtgggtggaggttcggtggggggaggtcgttgggtacaggccggttgggggggtcccctggacgaccttcctccgtggtgcacgtcctcgtcggtactttcccccttanaatagctatagcatgaacgtgggtccccgcaggcctccggagggggaaggggctgggcggttgggtttcattacattagtactagtagtagtaccccattatactacgcaagactcgngtaggaagggtccattccactactcctacgaagacgaacaagtcgaacctaaacgaactactacttagtatacctagaacctaaagtgaaaccacgccgtaggaacggaacggaaccggacgggaacctacggggtactttaggtaatttaacgtttacgtcggttaggtaaccggtaggttaagtttcgtttttacggtaacgttaacgttccgacggtaccggttaccgggggttaaccccgaacccccgggtaaccgggggg

SEQ ID NO: 365492 - DNA, 676 bp, Homo sapiens
  misc_feature: GZ8MTXP01CCRES.45.63.F08.1.454.CMB.2.raw
  modified_base (281)..(281): a, c, t, g, unknown or other
  modified_base (313)..(313): a, c, t, g, unknown or other
  modified_base (662)..(662): a, c, t, g, unknown or other
tcagacgcgatcgacacgaccggtgctcgatttagcgatcgtataagggggagagaggtgccttagccctggattccaaggcatttccacttggtgatcagcactgaacacagaggactcaccatggagttggggctgtgcttgggttttccttgttgcttattttagaaggtgtcagtgtgaggtgcagcgtggtggagtcgtggggggagcttggacaggccggtcggggggtccctggacgacctctccgtgtgcagcctcgtggtacttccccttanaatagctaatgctagtagaacgtcgggtcccncaggctaccggaggggacggggcgtcgggtcggttgggtttacaagttactaatttaacgtactaacggtagtacgtacccctatatacctacgacaaacgtacttcgtagtagggaacgggtcctacttaccaacctactcctacgaagaacgaacgtaaatcggaaaccaaaacgtaaccttacctaacgttgttaaactcttaaggaaactaaaagttacggaaaactacggaccgtaaggaacggaacggaacggaaggacccagggtactaggttaaattacgttacgtggcgaaggtagttacgtttgtttcgtgtaactcgacggtcgttacggggttcccncccgggtaacgggg

SEQ ID NO: 365493 - DNA, 602 bp, Homo sapiens
  misc_feature: GZ8MTXP01B73O0.45.63.F08.1.454.CMB.2.raw
  modified_base (267)..(267): a, c, t, g, unknown or other
  modified_base (379)..(379): a, c, t, g, unknown or other
  modified_base (552)..(552): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtgggggagcttggtacagccgtgggggtccctgagactctcctgtgcagcctctgacttcccctnaatagctatagcatgaacgtcgggtcccgccgaggcctccggaaggggagggggctgggcggttgggtttacattactattagtactagtagtacgtaccccatatactacncaagacttgtgtaggaacgggccgtattccgactatcctacaagacgacaagtcgaaccaaagtaactcaacttgtactactacgaactaaagtacgaacacgtcctaggaagacggaacggacggaccgacgtcttagtaacttaagttcgtgttggacgtagttacgtttntttcggtaatactcgaagtcggttacggtcccgttaaccccggtcggggg

SEQ ID NO: 365494 - DNA, 554 bp, Homo sapiens
  misc_feature: GZ8MTXP01A81EL.45.63.F08.1.454.CMB.2.raw
  modified_base (254)..(254): a, c, t, g, unknown or other
  modified_base (295)..(295): a, c, t, g, unknown or other
  modified_base (330)..(330): a, c, t, g, unknown or other
  modified_base (449)..(449): a, c, t, g, unknown or other
  modified_base (474)..(474): a, c, t, g, unknown or other
  modified_base (499)..(499): a, c, t, g, unknown or other
  modified_base (503)..(503): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggagcttgggtacagccgtggggggtccctgagactctcctgtgcagcctntggattcccccttcaatagctatagcatgaacgtgggtccncaggctcgagggaggggctggcgtgggttcatacnttagtactagtagtagtaccccatatactacgcaagctctgtagaacgggccgtattcaccgtatcctcagagacaagtcgaccgaaagaacctcactgtactctagacaaatgaaacngcctgacgagacgaggacacggtcngtaactattacgtgttagcgtaagngttntttcggtaagtactcccgaaggtcgacgggtttcgcccccgggtaaggggg

SEQ ID NO: 365495 - DNA, 549 bp, Homo sapiens
  misc_feature: GZ8MTXP01CYUHX.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttggtacagccgtggggggtccctgagactctcctgtgcagcctctggacttccccttcaatagctatagcatgaactgggtccgccaggctccgagggaaggggctggcgtgggttcatacattagtactagtagtagtaccccatatactacgcaagactctgtgaagggccgattcaccatctaccagagacaatgtacaagtaactcactgtatctagacaaatgaacagcctagagagacgaggacacggctgtaactattactggttgacggtagagttatttttcggtaagttactccaggcgttacgggttcccgaaccccggtcggggg

SEQ ID NO: 365496 - DNA, 666 bp, Homo sapiens
  misc_feature: GZ8MTXP01BW2JR.45.63.F08.1.454.CMB.2.raw
  modified_base (282)..(282): a, c, t, g, unknown or other
  modified_base (571)..(571): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagcgtggtggagtcggtgggggagtcttgggtacaggccggtggggggtccctggacgacttcctccgtgtgcagcctcgtgtacttcccctanaatagctaatagctagtagaacgtcgggtacccgccgaggtccgtaccggaggggaacggggtcgtgggcggttagggtttcaagttacgtagtttaagtacgttagtagtacgtacccctatactactacgctaaagaccttcgtaggtagggaacgggccctattccgaacctctcctaccgaagacgtaacaacgttcgaaaccgaaagtaacctctacgtagtactctagaacctaaagtacgaaaccagtaccgtaggaacgaaggacggacggaacaccggtnttagtaattacttacggtggttagtcgtaagttacgtttgtttacggtgtactccgacggtccggttaccgggttcccgaacccgggtaacgggg

SEQ ID NO: 365497 - DNA, 642 bp, Homo sapiens
  misc_feature: GZ8MTXP01CMMYJ.45.63.F08.1.454.CMB.2.raw
  modified_base (274)..(274): a, c, t, g, unknown or other
  modified_base (468)..(468): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcgttggtacaggccgtggggggtccctgagactctcctgtgcagcctctggtactttcccccttanaatgctatagcatcgaacgtcgggtcccgccgaggcctccggagggggacggggcgtgggtcggttggggtttcagttactagtttagtacgtagtagtacgtacccatatactacgcaagtactcgtaggtaggaacgggtcctatcaccatcctacagagacaatcgaccaaagactcacttgtatcgtaanaacgaagtacgaacacgcgtaggaacgaacggaacggaacggtaccgtacggtacttaggttaattacgttacggtaggacgtacggtaagttaacgtttcgttttacggtaagttaccgttcgacggttacccgggttaccggggttaaccccggttaaccccggggtcgggg

SEQ ID NO: 365498 - DNA, 593 bp, Homo sapiens
  misc_feature: GZ8MTXP01EFNV3.45.63.F08.1.454.CMB.2.raw
  modified_base (258)..(258): a, c, t, g, unknown or other
  modified_base (271)..(271): a, c, t, g, unknown or other
  modified_base (280)..(280): a, c, t, g, unknown or other
  modified_base (298)..(298): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctgggtggaggtcgtgggggaggcttgggtacagccgtggggggtccctgagactctcctgtgcagcctntggacttcccctnaatagctanagcatgaactcgggtccncaggctccgagggaggggctggcgtgggtttcatacattagtactagtagtagtacccatatactacgcaagactctggtaggaacggggcctattccactatcctccaaggacgaacaatcggaaccctaaagaacctctaacgtcgttaatcgtacgaactaaaatcggaaacacggcctaggaacgacggaacggacggactacgggtctaggtaattattaacgtgttcggagtagttagttagttttcgaagtactccgaaggcttacgggttcccgcccggtaacgggg

SEQ ID NO: 365499 - DNA, 583 bp, Homo sapiens
  misc_feature: GZ8MTXP01ACCED.45.63.F08.1.454.CMB.2.raw
  modified_base (409)..(409): a, c, t, g, unknown or other
  modified_base (494)..(494): a, c, t, g, unknown or other
  modified_base (511)..(511): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtgggggtccctgagactctcctgtgcagcctctggacttccccttcaatagctatagcatgaacgtggccgcaggctccgagggaggggctggcgtggttcatacattagactagtagtagtaaccccatatactacgcaacgactcgtagtgaacggggcccaatttcaacctatcctaccaagganacaatcgacaaacgactacacttagtactacgttaggactaaagtcgaaacgacgacccgtagagacggaacgaggacgacggtntgtaactagttactggngtcggaagttagttacttttcgaaggttactcccggagtccggttacgggttcccgaacccgggtccggggg

SEQ ID NO: 365500 - DNA, 619 bp, Homo sapiens
  misc_feature: GZ8MTXP01DLTYX.45.63.F08.1.454.CMB.2.raw
  modified_base (270)..(270): a, c, t, g, unknown or other
  modified_base (278)..(278): a, c, t, g, unknown or other
  modified_base (436)..(436): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgcttattttagaaggtgtccagtgtgaggtgcagctggtggagtcgtgggggagcttggacaggccgtggggggtccctgagactctcctgtgcagcctctggattcccccttanatagctanagcagtagacgtcggccgcgaggcgcggagggacgggtcgtggtcggttggttactatactattagtactagtagtacgtacctatatactacgactaacgtactgtaggtacgggaacgggtcctaactccactactacctacaaggaacgaacaanacgaacctaaataacctacacttagtactactacgaactaaagtacgaaacgacgtacgtaggaacgacggaacgaggtacgacggtatagttaatacgttagtacggagtacggtaggttagttcgttttacggtgtacgttccggaggtcccggttaccgggtcccggaacccgggtcggg

SEQ ID NO: 365501 - DNA, 640 bp, Homo sapiens
  misc_feature: GZ8MTXP01CE2HW.45.63.F08.1.454.CMB.2.raw
  modified_base (218)..(218): a, c, t, g, unknown or other
  modified_base (362)..(362): a, c, t, g, unknown or other
  modified_base (395)..(395): a, c, t, g, unknown or other
tcagacgcgatcgacacgaccggtgctcgatttagcgatcgtataagggggaatcagtcccactcaggacacagcatggacatgagggtccccgctcagctcctggggctcctgctgctctggttcccaggtgccaggtgtgacatccagatgacccagtctccatctgccatgtctgcatctggtaggagacacagtcacatctacttggtcggggnagtcgagggcattagctaattattagcctggttcagacaagaaaccgagggtaaacgtccctaagccgtctgatctatgctgctatccgtagttcgacgtaaaggtcgggtacccagtacccgaggtcaggcgacgtaaggtgngtcggtagggactacgtacttcactactacaanaactcagcacgtcgtacgacaggtccttagtaacgttacttttacgaaccgtttaaactttaacgtttaccttcggttaaaccctaagtacgtaacgtttaaacttaacgtttaaaccggtttaccccgttagtttacgggtttaaccgggaacccggttaggggtaacccgttaagtccggtaagggacgttaacgttaacggtaaaacgtaccgttggaggtcccttatccttaacgttaacg

SEQ ID NO: 365502 - DNA, 656 bp, Homo sapiens
  misc_feature: GZ8MTXP01ARALP.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgcttattttagaaggtgtccagtgtgaggtgcagcgtggtggagtcgtgggggagtcgttggtacaggccggtgggggtccctggagactctcctgtgcagtcctcgtcggtacttccccttacaatgactatagcagtacgaacgtcgggtcccgacgacggcctaccggaagggggaacgggggtcgtgggtccggttgggtttacattacgtagtttagtacgtagtagtacgtaacccctatactactacgcaaagtacctgtgtaggaaacgggtcctattcacctatcctaccaaggaacgaacaagtacgaaccctaaacgaacctacgtacttagttactccgtaagaaccaaagtacgaaaccacggtacctaggaacgaggaaccggaacggaccgtaccggtctagttaatattcgtggttcgacgtaagttacgttacgttttcgaagtactccgaggtccgttaccgggttcccgaacccggtcggggg

SEQ ID NO: 365503 - DNA, 598 bp, Homo sapiens
  misc_feature: GZ8MTXP01EVS0Y.45.63.F08.1.454.CMB.2.raw
  modified_base (271)..(271): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacagccgtggggggtccctgagactctcctgtgcagcctctggacttcccccttnaatagctatagcatagaacgtgggtccgccgaggctccgaggggaggggctgggcgtgggtttcatactattagtactagtagtagtaccccatatactacgcaagactcgtgtaggaacgggccgtattccacctatcctaccagaagacaatcgaccaaagaacctacacttgtactctagactaaatgaaacagcctagaggaacgacggacggacgacgggtctggtaattacgttacgtggttacgagtaaggagtttcgttttcggaagttactaaccgaggtaccgttacggggttccccgaaccccgggtaaccggggg

SEQ ID NO: 365504 - DNA, 683 bp, Homo sapiens
  misc_feature: GZ8MTXP01CKX69.45.63.F08.1.454.CMB.2.raw
  modified_base (271)..(271): a, c, t, g, unknown or other
tcagacgcgatcgacacgaccggtgctcgatttagcgatcgtataagggggagagaggtgccttagccctggattccaaggcatttccacttggtgatcagcactgaacacagaggactcaccatggagttggggctgtgctgggttttccttgttgctatttagaaggtgtccagtgtgaggtgcagctggtggagtcgtggggggagcttggtacagccgtggggggtccctgagactctcctgtgcagcctctggacttcccccttanaatagctatagcagtacgacgtcggccgcgaggcgtacggaggggacgggcgtggtcggtaggttacaatactagttaagtactaagtagtaactaacccaataactacacgacaaagtacttcgtagggtacgggaacggggtcctacttaccaacctactacctacgaagaacgtaacaaagtacgaaaccgtaaaacgtaacctactaacgttacgtaactacgtaagaacgtaaacgtaacgtaaacgaacgtaccgtacggaacggaacggaaacggaacggtaacgacggtacgtaagttaagttaagttacgtacggttacggtacggtagttagttacgtttacgttaagtacgtaacgtacggtacggttaccgggtaacccggttaacccgggtaaccgggg

SEQ ID NO: 365505 - DNA, 590 bp, Homo sapiens
  misc_feature: GZ8MTXP01BH6H1.45.63.F08.1.454.CMB.2.raw
  modified_base (508)..(508): a, c, t, g, unknown or other
  modified_base (513)..(513): a, c, t, g, unknown or other
  modified_base (518)..(518): a, c, t, g, unknown or other
  modified_base (529)..(529): a, c, t, g, unknown or other
  modified_base (545)..(545): a, c, t, g, unknown or other
  modified_base (552)..(552): a, c, t, g, unknown or other
  modified_base (556)..(556): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggtcttggtacaggccgtggggggtccctgacgactctcctgtgcagcctctggacttccccttacaaatgctatagcatcgaacgtcgggtccgcagggcctccggaaggggagggggctgggcggttgggttcaatcgtattagtactaagtagtagtacccctatatactacgcaaagtactcgtggtacgggaacgggcctaattccacctatccctacaggacgaacaacgtcgaaccaaagtaacctctacttagtactccgtagacaaatcgaacagcctagagagacgagtcncggtntagtntaacttgtagnggacgtagttacgttnttttcgngtanccgcgcgttaccgggtccgaacccgggtccgggg

SEQ ID NO: 365506 - DNA, 622 bp, Homo sapiens
  misc_feature: GZ8MTXP01DMIYO.45.63.F08.1.454.CMB.2.raw
  modified_base (252)..(252): a, c, t, g, unknown or other
  modified_base (264)..(264): a, c, t, g, unknown or other
  modified_base (267)..(268): a, c, t, g, unknown or other
  modified_base (270)..(270): a, c, t, g, unknown or other
  modified_base (272)..(273): a, c, t, g, unknown or other
  modified_base (275)..(275): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctatttagaaggtgtccagtgtgaggtgcagctggtggagtcgtgggggagcttggtacagccgtggggggtccctgagactctctgtgcagcctntgattcccctanatnnanannangacgtcggccgcgagcgcggagggaggcgtggtcgtggttacatactagttagtactagtagtactaaccatactactacgcaagtactgtagtaggaacggcctactacactactccacgaagacgaacaagtacgaactaaacgtacctacacttagtactactagaacgtaaatacgaaacacgtacgagaacgaacggaaacggaggtaacgacggtacgttaagtaattacgttacgtagttacggtaacgtaaggttaacgtttacgttttacggtaagttactaaccggtacggtacggttacccggggttaaccccggttaaccccggggtaaccgggg

SEQ ID NO: 365507 - DNA, 627 bp, Homo sapiens
  misc_feature: GZ8MTXP01BI3DL.45.63.F08.1.454.CMB.2.raw
  modified_base (265)..(265): a, c, t, g, unknown or other
  modified_base (293)..(293): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggagcttggtacaggccgtgggggtccctgagactctcctgtgcagcctctgacttcccctnaatagctatagcagtgaacgtggtcccncgaggcctccggaggggtaacgggctggtcggttgggtttacagttactattagtactagtagtacgtacccattactactacgcaagtacttcgtagtacgggaaacgggcctaattcaacctagtcctacagtacgaacaagtacgaccctaaagactcgaacttgtaactcgtacgaactaaattcggaaactacggtaccctaggaacgaggaaccgacgaaccgtacggtacttaggtaacttagttacgttggttgaccgtagttagttcgttttcggaattacgtaacgtacgtcggttaccggtcccggttcccggtaaccggggg

SEQ ID NO: 365508 - DNA, 634 bp, Homo sapiens
  misc_feature: GZ8MTXP01AEGUS.45.63.F08.1.454.CMB.2.raw
  modified_base (268)..(268): a, c, t, g, unknown or other
  modified_base (293)..(293): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtgggggagcttggtacaggccgtgggggtccctgagctctcctgtgcagcctctgacttccccctnaatgctatagcatgaactgggtccncaggctccgagggagggctggcgtgggtttcatacattagtactagtagtagtaccccatatactacgcaaagctctgtagaaggggtccattcaacctatcctaccaagagaacaatcgaccaaagtaactcaacgttgtaactctgaacctaaaagtcgaaacacgtacctggaagaacggaacggaaacggtacccgaacggggtacctttagggtaacttaaagtttaaccgtgggttagaccgggtaaagttaggtttaacttttttcccggaaggttaactttccgaaacggtccgttaaacggggtttccccggaaccccggttaaccgggggg

SEQ ID NO: 365509 - DNA, 705 bp, Homo sapiens
  misc_feature: GZ8MTXP01AXIK0.45.63.F08.1.454.CMB.2.raw
  modified_base (219)..(219): a, c, t, g, unknown or other
  modified_base (525)..(525): a, c, t, g, unknown or other
  modified_base (637)..(637): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgcttattttagaagtgtccagtgtgaggtgcagctggtggagtcgtgggggagtcgttgggtacnggccggtcgggggtccctggacgtactctccgtgtcgcacgtcctcgtcggtactttccccttacaatagtctatagctatagtaaccgtcgggtcccgccaggtcctacccggaagggggaacggggtcgtacgggcggtttaggggtttcaagtactaagttagttaacgtagtagttacgaaccctatatacgtacgcaaagtaccttcgtaggtacggaaacggggcctaactttccgaactacttccctacaagacgaaactaagtcgaaaccaaagaacctactaacttgtaactcgtanaacgtaaattacgaacacgaccgtagaacggaaggaaccggacggaacgtacccggtacgttaggttaaacttaacgttacggtacgttcgggtagtaagttacgggttttntttccgggttaattaaccggtcaacggtacggttaccgggtaaccccggttcccggttaacccggggg

SEQ ID NO: 365510 - DNA, 729 bp, Homo sapiens
  misc_feature: GZ8MTXP01BWJDV.45.63.F08.1.454.CMB.2.raw
  modified_base (269)..(269): a, c, t, g, unknown or other
  modified_base (274)..(274): a, c, t, g, unknown or other
  modified_base (277)..(277): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctcctgtgcagcctctggattcccccttanaatancanagcatagacgtcggccgcgaggccgtaccggaagggagggcgtggtcggttgggttacaataacgtagttagtacgtaagtacgtactaaccccaattaactacgtacgcaaacgtactgtagtacggaacgggcctataccaactactacctacgaagaacgaactaagtacgaaccgaaagtaaacctacgaacttacgtaacttacgtacgaaacgtaaaacgtacgaaaccgacggtaccgtaagggaacggaaacggaaaccgggtaacggtaacccgtaaccgggtactttaaggttaaacgtttaaacgtttacgttacggttacgggaaccggttaagttaacgggttttacgtttttaccgggttaacgtaaccgttaacccggtaacgggtaccggttaaacccgggggtttaacccccggaacccccggggttaacggggg

SEQ ID NO: 365511 - DNA, 575 bp, Homo sapiens
  misc_feature: GZ8MTXP01BSNUA.45.63.F08.1.454.CMB.2.raw
  modified_base (172)..(172): a, c, t, g, unknown or other
  modified_base (269)..(269): a, c, t, g, unknown or other
  modified_base (457)..(457): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgcttgggttttccttgttgcttattttagaaggtntccagtgtgaggtgcagctggtggagtcgtgggggagcttggtacaggccgtgggggtccctgagtactctctgtgcagcctcgtgactttcccctnaatgctatagcatgaacgtcggtccgcaggctccggagggagggctggcgttgggtttcatactattagtactagtagtacgtacccattatactacgcaagtactcgtgtaggaacgggtccattcacatcctacagagaacaagtgaacccaagtactcatgtactctagaactaaagtcgaaacncgacgagaacgagacgtacggacaggtacttgtaattacgttacgtgttgacgtagttacgtttcgtttcgaagttacgtaacgaggtccggttaccggtcccgcccgggtaacgggg

SEQ ID NO: 365512 - DNA, 620 bp, Homo sapiens
  misc_feature: GZ8MTXP01EJ815.45.63.F08.1.454.CMB.2.raw
  modified_base (220)..(220): a, c, t, g, unknown or other
  modified_base (278)..(278): a, c, t, g, unknown or other
  modified_base (282)..(282): a, c, t, g, unknown or other
  modified_base (287)..(287): a, c, t, g, unknown or other
  modified_base (557)..(557): a, c, t, g, unknown or other
  modified_base (564)..(564): a, c, t, g, unknown or other
  modified_base (575)..(575): a, c, t, g, unknown or other
  modified_base (588)..(588): a, c, t, g, unknown or other
tcagacgcgatcgacacgaccggtgctcgatttagcgatcgtataaggggagagaggtgccttagccctggattccaaggcattttccacttggtgatcagcactgaacacagaggactcaccatggagttgggctgtgcttgggttttccttgttgcttattttagaaggtgtcagtgtgaggtgcagctgggtggagtcgtgggggagtcttggtacnggccgtgggggtccctgacgtactctcgtgtcgcacgtcctctaggactttcccctanaatnactanagctatgacgtcggtcccgcgaggccgtaccggaggggaacggggtcgtgggtcgtttgggttacaagtactagttagtactagtacgtatacccattactactacacgaagtctcgtagtagggaaccgggctacttacactactcgtaccgaagacgacaactacggaaccaaagtacctcaacttgtaactattaccgaataaaagtcgaaaccagaccgtaggaaagacgaaaggacgaacgacggtctaagtaacttagttacgngttacgngtaagttgttnttttcgaagttcncgaacgtcgacggttccgaaccggtaaccggg

SEQ ID NO: 365513 - DNA, 722 bp, Homo sapiens
  misc_feature: GZ8MTXP01EDD6W.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagcgtgggtggaggttcggtggggggagtcgtttagggtacgacggtccggttgggggggtccctaggacgtaccttcctccgtggtcgcacgtcccttcgttcggtacctttccccctataaatacgactaatagctagtacgtaacgtcgggtcccgccgaaggccgtaccgggaagggggtacgggggtcgtaggggtcggtttagggttttacaagtttaacgtaagtttaagttacgtaaggttaagtaacgttaacccattaactacgtacgactaaacgtacttcggtagtacgggaacgggcctacttccgactatcccgtacgaaggacaactaagtacgaaccaaacgtaactacgacttagtaactcgtagaacgtaaatacgaaactacgctaggaacggaagaaacggacgacgtacgtacttaagtaacttagttcgtggttacgacggttaagttacgtttgtttcgtaagtacgtcgacggtacggttaccgggttccccgaacccggggtaacgggg

SEQ ID NO: 365514 - DNA, 723 bp, Homo sapiens
  misc_feature: GZ8MTXP01A4QEJ.45.63.F08.1.454.CMB.2.raw
  modified_base (287)..(287): a, c, t, g, unknown or other
  modified_base (682)..(682): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtgggggagtcttaggtacaggccgtgggggtccctgacgtactcctccgtgtgcacgtccttcgtcggtactttccccccgttanaaagtagtcctaataacggactaagtacgaaccggtcgggtaccccgaccgaggcccgtaccggaaggggggtaacggggtcgtacgggtcgggttcggggtttacaacgttaacgtaagtttagttaacgtagttaaggtacgtaaccacgttataccgtaacgctaaacgtactcgtaggtaggaacgggtacctagttaccacctactactacgaagtacgaacaactagaacccgaataacctactaacgtgttaactacgtacgtaactaaaacgtcgaaacgtaaccggtaccgaaggaaggtaacggaaaccggtaaggaaacccggtaccgggtatagggtaaacttgttaaccgtgaggtacgtaagttagtttcgtttagtctanccgtggtaccgttacgggtcccggttaacccgtaaccgggg

SEQ ID NO: 365515 - DNA, 674 bp, Homo sapiens
  misc_feature: GZ8MTXP01E34JJ.45.63.F08.1.454.CMB.2.raw
  modified_base (217)..(217): a, c, t, g, unknown or other
  modified_base (274)..(274): a, c, t, g, unknown or other
  modified_base (311)..(311): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggagcgttggtacnggtccggtgggggtccctgacgtactctcctgtgcagccttcgtcgtacttccctanaagtagtactatagactagtacgaacggtcggtcccnccgaggccgtacggaaggggagggcgtggtcgttggttcagtactagttagtatagtagtactaacccatatacgtacgacaaagtcttcgtaggtaacgggaacgggtcctaattcccacctacgttccctaaccgaaggaacgaactaaagtaccggtaaacccaaaacgtacctactacgttagttactacgtacgaaactaaagtacggaaaccacgtccgaggaacggaacgtacggacggtacgaacggttctaagttaactagttaccgtggttacgaacgtaaggttacgttttacgttacgtcggacttaaccggacgtcggttaccgggtccccggttaaccgggtcccgggg

SEQ ID NO: 365516 - DNA, 604 bp, Homo sapiens
  misc_feature: GZ8MTXP01CCWMR.45.63.F08.1.454.CMB.2.raw
  modified_base (220)..(220): a, c, t, g, unknown or other
  modified_base (274)..(274): a, c, t, g, unknown or other
  modified_base (424)..(424): a, c, t, g, unknown or other
  modified_base (450)..(450): a, c, t, g, unknown or other
  modified_base (458)..(458): a, c, t, g, unknown or other
  modified_base (467)..(467): a, c, t, g, unknown or other
  modified_base (474)..(474): a, c, t, g, unknown or other
  modified_base (484)..(484): a, c, t, g, unknown or other
  modified_base (494)..(494): a, c, t, g, unknown or other
  modified_base (521)..(521): a, c, t, g, unknown or other
  modified_base (554)..(554): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtgggggagtcttggtacnggccgtgggggtccctgagactctcctgtgcagtcctctgactttccccccttnaaatagctaagtagactatagaaaccgttcgggccccgccgagggcctaccggaagggggtaagggggtcgtggggcggtttgggggtttaccaagttaactaacgtttagtactaagtacgtagtaaccccatatactacgcaagactntgtagaagggtccatcacatcctcanagactaancgaacaaanactcatntatctagaanaaatacaacncgacgtagagagaacgagacgtacgtntagtaattagttagtgttgacgtagttacgttntttccgtaagtcgtccgtaggtccgttacgggttccccgaaccggtcggg

SEQ ID NO: 365517 - DNA, 529 bp, Homo sapiens
  misc_feature: GZ8MTXP02JEPFQ.45.63.F08.1.454.CMB.2.raw
  modified_base (267)..(267): a, c, t, g, unknown or other
  modified_base (474)..(474): a, c, t, g, unknown or other
  modified_base (496)..(496): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttcctgttgctattttagaaggtgtccagtgtgaggtgcagctggtggagtctgggggaggcttggtacagccgtggggggtccctgagactctcctgtgcagcctctggacttccccttnaatagctatagcatgaactgggtccgccaggctccgagggaggggctggcgtgggtttcatacattagtactagtagtagtacccatatactacgcagactctgtgaagggccgattcaccatctccagagacaatgaccaagaactcactgtatctgacaaatgaacagcctagagagacgaggtacacggctagtactattacgngtgacgagtacgttagtttcgngtactacgagtacgtacggtccgacccggtggg

SEQ ID NO: 365518 - DNA, 554 bp, Homo sapiens
  misc_feature: GZ8MTXP02JUJS7.45.63.F08.1.454.CMB.2.raw
  modified_base (292)..(292): a, c, t, g, unknown or other
  modified_base (507)..(507): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggattccccttcaatagctatagcatgaactgggtccnccaggctccgagggaggggctggcgtgggttcatacattagtactagtagtagtacccatatactacgcagactctgtgaagggccattcacatcctccagagacaatgaccaaagactcactgtatctgacaaatgaaacaggacctagaagacgacgacggacacgggctagttaactattacgtggtcgacggtagacggttatttttcggngttaactcccgaggtcgtacgggtttcccggacccccggttcggggg

SEQ ID NO: 365519 - DNA, 549 bp, Homo sapiens
  misc_feature: GZ8MTXP02HRLV8.45.63.F08.1.454.CMB.2.raw
  modified_base (269)..(269): a, c, t, g, unknown or other
  modified_base (295)..(295): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctcctgtgcagcctctggacttcccccttnaatagctatagcatgaactgggtccncgaggcctccgaggggaggggctggcgtgggtttcatacattagtactagtagtagtaccccatatactacgcagactctgtgaacggggtccgattccgaccatcctaccagagaacaatcgacaaagactcactgtatctgacaaatgaacagcctagagagacgaggacaggctagtatattactagtgacgtagtagttacttttcgtaagtactccgagacgtacgggttacccgacccggtacggggg

SEQ ID NO: 365520 - DNA, 526 bp, Homo sapiens
  misc_feature: GZ8MTXP02JJUNR.45.63.F08.1.454.CMB.2.raw
  modified_base (394)..(394): a, c, t, g, unknown or other
  modified_base (490)..(490): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagcctggggggtccctgagactctcctgtgcagcctctggattccccttcaatagctatagcatgaactgggtccgccaggctccgagggaggggctggcgtgggtttcatacattagtactagtagtagtacccatatactacgcagactctgtgaagggccattcacatctcagngacatgacaagactcactgatctgacaaatgaacagcctagagagacgaggacgacgctagtatacttacgtagtgacgagtacggtattttacgngtactaccgagtcgtacggttccgaccccgtcgggg

SEQ ID NO: 365521 - DNA, 528 bp, Homo sapiens
  misc_feature: GZ8MTXP02J2KI2.45.63.F08.1.454.CMB.2.raw
  modified_base (473)..(473): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttgggtacaggcctggggggtccctgagactctcctgtgcagcctctggattccccttcaatagctatagcatgaactgggtccgccaggctccgagggaaggggctggcgtgggtttcatacattagtactagtagtagtaccccatatactacgcagactctgtgaagggccgattcacatctccagagacaatgccaagaactcaactgtatctgacaaatgaacagacctgagagacgagacacggctagtatattacgngtgacgagagttatttcgaagtactaccgagtcgtacggttccgacccgtcgggg

SEQ ID NO: 365522 - DNA, 533 bp, Homo sapiens
  misc_feature: GZ8MTXP02HJYDE.45.63.F08.1.454.CMB.2.raw
tcagacgcgatcgacacgaccggtgctcgatttagcgatcgtataaggggagagaggtgccttagccctggattccaaggcatttccacttgttgatcagcactgaacacagaggactcaccatggagttggggctgtgctgggttttccttgttgctattttagaaggtgtccagtgtgaggtgcagctgggtggagtcgtgggggaggcttggtacaggccgtggggggtccctgagactctcctgtgcagcctctggattccccttcaatagctatagcatgaactgggtccgccaggctccgagggaagggctggcgtgggttcatacattagtactagtagtagtaccccatatactacgcagactctgtgaagggccgattcaccatcctccagagacaatgaccaaagaactcactgtatctgacaaatgaacagacctgagagacgaggacaggctaggtatattactgtgacgagtagttattttcgaagtatccgagccgtacggttccgaccccggtcgggg

SEQ ID NO: 365523 - DNA, 529 bp, Homo sapiens
  misc_feature: GZ8MTXP02G0YYF.45.63.F08.1.454.CMB.2.raw
  modified_base (338)..(338): a, c, t, g, unknown or other
  modified_base (361)..(361): a, c, t, g, unknown or other
tcagacgcgatcgacacgaccggtgctcgatttagcgatcgtataagggggaatcagtcccactcaggacacagcatggacatgagggtccccgctcagctcctggggctcctgctgctctggttcccaggtgccaggtgtgacatccagatgacccagtctccatctgccatgtctgcatctgtaggagacacagtcaccatcacttgtcgggcgagtcagggcattagcaattattagcctggttcagcagaaaccagggaaacgtcctaagcgcctgatctatgctgcatccagtttgcaaaggtggggtcccatccaaggttcagcggcagtgntctgggacagacttcactctcanaatcagcagcctgcagcctagaacgtatttgactaactttattactgtactacagactaattaacttacgttacccgtacgtacggttttacggaccgtaagggggaccaaggtcgtaggaacgtactaacgaaaacgtaacgtggtacggactacggaccacctacg

SEQ ID NO: 365524 - DNA, 522 bp, Homo sapiens
  misc_feature: GZ8MTXP02FW4G5.45.63.F08.1.454.CMB.2.raw
  modified_base (369)..(369): a, c, t, g, unknown or other
  modified_base (486)..(486): a, c, t, g, unknown or other
  modified_base (492)..(492): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggattccccttcaatagctatagcatgaactgggtccgccaggctccgagggaggggctggcgtgggttcatacattagtactagtagtagtacccatatactacgcagactntgtgaagggccattcaccatctccagagaacaatgaccaaagaactcactgtatctgacaaatgaacagcctagagagacgaggacacggctagtatattatgtgacgagaagtttntttcgngtactcgagcgtacggtccgaccggtcggg

SEQ ID NO: 365525 - DNA, 608 bp, Homo sapiens
  misc_feature: GZ8MTXP02H2TQX.45.63.F08.1.454.CMB.2.raw
  modified_base (259)..(259): a, c, t, g, unknown or other
  modified_base (275)..(275): a, c, t, g, unknown or other
  modified_base (279)..(279): a, c, t, g, unknown or other
  modified_base (283)..(283): a, c, t, g, unknown or other
  modified_base (285)..(285): a, c, t, g, unknown or other
  modified_base (303)..(303): a, c, t, g, unknown or other
  modified_base (373)..(373): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctgggtggagtcgtgggggagtcttggtacaggccgtggggggtccctgagactctcctgtgcagcctntcggattcccccttanatanctanancatagacgtcggccgcgngctacggaggggacggcgtggtcggttggttacatactattagtacgtagtagtactaccatactacacncagtactgtagtaggacggcctattccactactccacagacgaacaactcgaaccaagactactactgttactactagaactaaagtacgaaaccacggaccgtaggaaggacggaacgggaacgaccgacggtacttaagttaattacgttacgtagtacggacgtagtacgtttacgtttacgtaacgtacgtacgtacggtaccggttaccggttacccgacccgggtcggg

SEQ ID NO: 365526 - DNA, 755 bp, Homo sapiens
  misc_feature: GZ8MTXP02GHD7H.45.63.F08.1.454.CMB.2.raw
  modified_base (268)..(268): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagcctggggggtccctgagactctcctgtgcagcctctggattcccccttanaatagctatagcatacgaacgtcgggtcccgccgaggcctaccggaaggggacggggcgtggggtcggtttgggtttaccaagttacgtaagtttaacgtaacgttaaggttaaggttaacgtaacccctaattaacttaaccgtacgactaacgtaccttcgtagggtaacgggaaaccgggggtacccgtaacttacccgaacctaacttcccgtacccgaaaggaaacgaaacctaaaagtccggaaacccgaaaacgtaaacccttaccgtaaacgtttacgttaacttaccgtaacggaaaccttaaaaagttacggaaaaaccgtacgggtacccgtaagggaaacggaacgggaaaccgggaaacgggaaccgtacggggtacttaggttaaacttacgtttacgtcggtacgacggtaagtacgtttattttcggaagttactccgaggtccgtacggtacccggaccccggtcggggg

SEQ ID NO: 365527 - DNA, 530 bp, Homo sapiens
  misc_feature: GZ8MTXP02HK2CH.45.63.F08.1.454.CMB.2.raw
  modified_base (441)..(441): a, c, t, g, unknown or other
  modified_base (446)..(446): a, c, t, g, unknown or other
  modified_base (496)..(496): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttccccttcaatagctatagcatgaactgggtccgccaggcctccgagggaacggggctggcgtgggtttcatacattagtactagtagtagtacccatatactacgcagactctgtgaaaggccgattcaccatctcccagagacaaatgaccaagactcactgatctgacaaatgaacngaccngagagacgaggaccaggctagtatagttactgtgacgagagtattttcgngtactccacgctaacggtccgtaacccgtcgggg

SEQ ID NO: 365528 - DNA, 545 bp, Homo sapiens
  misc_feature: GZ8MTXP02FXYSQ.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctgggtggagtcgtgggggaggcttggtacagccgtggggggtccctgagactctcctgtgcagcctctggattccccttcaatagctatagcatgaactgggtccgccaggctccgaggggaaggggctggcgtggggtttcatacattagtactagtagtagtaccccatatactacgcagactctgtagaaagggccattcaccatctaccagagacaatcgaccaaagaactcactagtatcctagacaaaatgaaacagcctagagaagacgaaggacacggctagtatattactgtgacgagacgtatttcgaagtactccgagcgtacggttcccgaccccgtacggggg

SEQ ID NO: 365529 - DNA, 555 bp, Homo sapiens
  misc_feature: GZ8MTXP02JZLFU.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtgaagtcgtgggggaggcttgggtacagccgtggggggtccctgagactctcctgtgcagcctctggacttccccttcaatagctatagcatgaactgggtccgccaggctccgagggaggggctggcgtgggttcatacattagtactagtagtagtaccccatatactacgcagactctgtaggaaggccgattccaccatctccagagacaatcgaccaacgaactacactgtactctgacaaactagaacacgaccgtagaggaggaacggacggacgacggacgtagtactagggggttactaggtgcgagacgtagtttcgtgtactcacgtacgtacggttaccgacccgtcgggg

SEQ ID NO: 365530 - DNA, 550 bp, Homo sapiens
  misc_feature: GZ8MTXP02GNC20.45.63.F08.1.454.CMB.2.raw
  modified_base (270)..(270): a, c, t, g, unknown or other
  modified_base (295)..(295): a, c, t, g, unknown or other
  modified_base (370)..(370): a, c, t, g, unknown or other
  modified_base (463)..(463): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcagcctctggacttccccttnaatagctatagcatgaactggtccncaggctcgagggaggctggcgttggttcatacattagtactagtagtatacccatactactacgcagactcgtgngaaggcgatcacatctacagacgacaatcgaccaaagactcatagtactctagacaaagtgaacagtccagagacgacggaagacgaccgggnttagtattacgttacgtggtgacggtagtagtagttttccggaattacgtacgtacgcgtaacggtttcccggaccccggtacgggg

SEQ ID NO: 365531 - DNA, 577 bp, Homo sapiens
  misc_feature: GZ8MTXP02HHXLM.45.63.F08.1.454.CMB.2.raw
  modified_base (217)..(217): a, c, t, g, unknown or other
  modified_base (299)..(299): a, c, t, g, unknown or other
  modified_base (456)..(456): a, c, t, g, unknown or other
  modified_base (534)..(534): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacngccgtggggggtccctgagactctcctgtgcagcctcgtggtactttcccctcaatagctatagcatgaacgtcgggtaccnccgaggcctccgaggggagggctgggcgtgggttcatacattagtactagtagtagtaccccatactactacgcagtactcgtgtggaacgggcctattcacctatcctaccgagacgacaagtcgacaagactcactgtactcagacaaatgaacngacctgaagagacgaggacacggtactgtaactattacgtcggtagacggtagtagttacgtttttcgaacggttacnccggtacgtccgttacggggttcccgtaccccgggtacggggg

SEQ ID NO: 365532 - DNA, 543 bp, Homo sapiens
  misc_feature: GZ8MTXP02GY4HH.45.63.F08.1.454.CMB.2.raw
  modified_base (294)..(294): a, c, t, g, unknown or other
  modified_base (399)..(399): a, c, t, g, unknown or other
  modified_base (504)..(504): a, c, t, g, unknown or other
  modified_base (510)..(510): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttcccctcaatagctatagcatgaactgggtccnccaggctccgagggagggctggcgtgggttcatacattagtactagtagtagtaccccatatactacgcagactcgtgtagaagggccattcaccatcctcaganacaatgaccaagaactcactgtatctgacaaatgaacagcctagaagaggacgaggacacgggtctaggtaatacgttactgtacgacgaagtagttattttcgngttacnccgagtcgtacggttcccgaacccggtcggggg

SEQ ID NO: 365533 - DNA, 637 bp, Homo sapiens
  misc_feature: GZ8MTXP02IJ960.45.63.F08.1.454.CMB.2.raw
  modified_base (541)..(541): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctcgtggtacttccccttacaatagctaatagcatgaacgtcgggtccgccgaggcctccgaggggaggggcgtggcggttgggtttcaagtactagttacgtactagtagtacgtaaccccattactactacgctaagactcgtgtaggaaacggggccctattccgaacctagtcctaccgaaagacgaacaatcgacgaaagtaacctacacgttagtactcgtagaaccaaaagtacgaacacggaccctaggaacgaacggaacggaacgggaaccaccgggtnttaacggttataagttacgtagtggacgagtacgtttacgttttacgtaagtactaccgtacggaccgttacggttacccgaccccggtacggggg

SEQ ID NO: 365534 - DNA, 529 bp, Homo sapiens
  misc_feature: GZ8MTXP02HHJ49.45.63.F08.1.454.CMB.2.raw
  modified_base (268)..(268): a, c, t, g, unknown or other
  modified_base (293)..(293): a, c, t, g, unknown or other
  modified_base (399)..(399): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttcccctnaatagctatagcatgaactggtccnccaggctccgagggaggctggcgtgggttcatacattagtactagtagtagtacccatatactacgcagactctgtaggaacgggccgattcacctatctccaganacaatcgacaagaactcactgatctgacaaatgaacagcctagacgagacgacggacacggctagtatattcgtgtgacgtagagttactttcgaagtactccgagcgtacggttccgacccggtcgggg

SEQ ID NO: 365535 - DNA, 576 bp, Homo sapiens
  misc_feature: GZ8MTXP02GDJSE.45.63.F08.1.454.CMB.2.raw
  modified_base (251)..(251): a, c, t, g, unknown or other
  modified_base (270)..(270): a, c, t, g, unknown or other
  modified_base (297)..(297): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcngcctctggacttccccttnaatagctatagcatgaacgtgggtccnccaggcctccgagggaggggctggcgttgggtttcatacagttagtactagtagtagtacccatatactacgcacgactcgtgtaggaaacgggccgtattccaacctactcctaccaagagaacaatgaccaagaactcactagtactctagacaaagtgaaacagacctaggagaagacggaggacgacgctagtactagttactggtcgacgtagtacgttagttttcggaagttactacccgaggtaccgtacggttcccgaacccggtcggggg

SEQ ID NO: 365536 - DNA, 525 bp, Homo sapiens
  misc_feature: GZ8MTXP02JD6GC.45.63.F08.1.454.CMB.2.raw
  modified_base (421)..(421): a, c, t, g, unknown or other
  modified_base (458)..(458): a, c, t, g, unknown or other
  modified_base (469)..(469): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggtttccttgttgctattttagaaggtgtccagtgtgaggtgcagctggtggagtctgggggaggcttgggtacagccgtggggggtccctgagactctcctgtgcagcctctggacttccccttcaatagctatagcatgaactgggtccgccaggctccgagggagggctggcgtggttcatacattagtactagtatagtacccatatactagcagactcgtgtgaaagggccgatcaccatctccaagagacaatgaccaaagaactcactgtanctgacaaatgaaacagcctgagagacgaggacacggntagtatactangtgacgagtagttatttcgtaagtactacagtacgtacggtaccgacccggtgggg

SEQ ID NO: 365537 - DNA, 536 bp, Homo sapiens
  misc_feature: GZ8MTXP02JNVBJ.45.63.F08.1.454.CMB.2.raw
  modified_base (296)..(296): a, c, t, g, unknown or other
  modified_base (420)..(420): a, c, t, g, unknown or other
  modified_base (428)..(428): a, c, t, g, unknown or other
  modified_base (461)..(461): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacagccgtggggggtccctgagactctcctgtgcagcctctggacttccccttcaatagctatagcatgaactgggtccnccaggctccgagggagggctggcgtgggttcatacattagtactagtagtagtaccccatatactacgcagactctgtagaacgggccgattcaccatctccagacgacaatcgaccaagactnactgatcngacaaatgaacagctagagagacgagacacggntgtactatacgtgtgacgagtacgtattttcgaagtacgtaccacgcgtacggtttacccgacccgttccggggg

SEQ ID NO: 365538 - DNA, 547 bp, Homo sapiens
  misc_feature: GZ8MTXP02GXVC2.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtcctgagactctcctgtgcagcctctggattcccctcaatagctatagcatgaactcgggtccgccaggctccgaggggaaggggcgtggcggttgggtttcagtacatttagtactaagtagtagtaccccatatactacgacagactctgtgaaagggcgattcacatctccagagacaatcgaccaagaacacactagtatactgacaaatagaacagaccagacgagacgaggacgacggctagtatattacgtgtagcggagagtattttcggaagtattccgaagcgtaacggttccgaacccgtccggggg

SEQ ID NO: 365539 - DNA, 547 bp, Homo sapiens
  misc_feature: GZ8MTXP02GI6SK.45.63.F08.1.454.CMB.2.raw
  modified_base (270)..(270): a, c, t, g, unknown or other
  modified_base (296)..(296): a, c, t, g, unknown or other
  modified_base (394)..(394): a, c, t, g, unknown or other
  modified_base (435)..(435): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcagcctctggacttccccttnaatagctatagcatgaactgggtccnccaggctccgagggaaggggctggcgtgggttcatacattagtactagtagtagtacccatatactacgcagactctgtgaaggcatcacatctcagngaacaatcgacaagaactcactgtatctgacaaatgaaacngcctagagagacgagacgacgctagtataattacgtgtgacgagtagttacgtttttacgtaagtaacgttccgaaggtcgtacgggtttacccgacccccggtacgggggg

SEQ ID NO: 365540 - DNA, 567 bp, Homo sapiens
  misc_feature: GZ8MTXP02JF20D.45.63.F08.1.454.CMB.2.raw
  modified_base (269)..(269): a, c, t, g, unknown or other
  modified_base (452)..(452): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttccccttnaatagctatagcatgaactgggtccgccaggcctccgaggggaggggctggcgtgggttcatacattagtactagtagtacgtacccatactactacgcagactcgtgtaggaacgggccgattcacctatacctccaagacgacaatcgaccaagaactcatgtatctagacaaatgaaacncgacctagagacgacgacggacgacggctagtattagttactggtcgacgtagtaagttacgttttcgaagttacaccgtagtaccgtacgggttacccgaccccggtacggggg

SEQ ID NO: 365541 - DNA, 562 bp, Homo sapiens
  misc_feature: GZ8MTXP02IMTAE.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagcctggggggtccctgagactctcctgtgcagcctctggacttccccttcaatagctatagcatgaactgggtccgccaggctccgagggaaggggctggcgtgggttcatacattagtactagtagtagtaccccatatactacgcagactctgtgaagggccgattcaccatcctccagagacaatgaccaaagaactcaactgtaatctagacaaaagtgaaacaggacctgagagacgaggacacgggctagttatattacgtgtggacgtaggtacgttaatttttcggaagttactaccgacgtaccggtacggttacccgtaacccccggtcggggg

SEQ ID NO: 365542 - DNA, 531 bp, Homo sapiens
  misc_feature: GZ8MTXP02I9FKM.45.63.F08.1.454.CMB.2.raw
  modified_base (270)..(270): a, c, t, g, unknown or other
  modified_base (296)..(296): a, c, t, g, unknown or other
  modified_base (482)..(482): a, c, t, g, unknown or other
  modified_base (498)..(498): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacagccgtggggggtccctggagactctcctgtgcagcctctggattccccttnaatagctatagcatgaactgggtccnccaggctccgagggaggggctggcgtgggtttcatacattagtactagtagtagtaccccatatactacgcagactctgtgaaggggccattcacatctcagagacatgacaagaactcactgtatctgacaaaagtcgaaacagacctagacgaagacggaagacacggctagtatattactgtnacgagagtattttcgngtactcgagcgtacggttccgaccccggtgggg

SEQ ID NO: 365543 - DNA, 622 bp, Homo sapiens
  misc_feature: GZ8MTXP02IEHJM.45.63.F08.1.454.CMB.2.raw
  modified_base (308)..(308): a, c, t, g, unknown or other
  modified_base (387)..(387): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggaggtcgtggggggaggcttgggtacagccggtggggggtccctgagactctcctgtgcagcctcgtggtacttccccttacaatagctaatagcatagaacgtcggggtcccnccgaggcctaccggaggggaggggcgtgggcgttgggttcatactattagtactagtagtagtacccatactactacgnagctcgtgtaggacggggacctattccacctatcctaccgagtagacaatcgaacaagactacactagtatactagactaaaatacgaaacgacggtcctaggaacggaagacggacggtaacgacgggacttagtaacttattacgtgtacggtacgaagttaggtttacttttcggtaagttacgttaccgacggtaccgttaccgggttacccggtacccccggtacggggg

SEQ ID NO: 365544 - DNA, 626 bp, Homo sapiens
  misc_feature: GZ8MTXP02JHNUN.45.63.F08.1.454.CMB.2.raw
  modified_base (271)..(271): a, c, t, g, unknown or other
  modified_base (280)..(280): a, c, t, g, unknown or other
  modified_base (297)..(297): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcagcctctggattcccccttanaatagctanagcatcgacgtcggccncgaggctacggaggggacgggcgtggtcggttggttacatactagttagtactagtagtatacccatactactacgcagtactgtggtacggaacgggcctataccacctactcctaccgaagacgaacaatcgaccaaagtaacctacacgtagtactcgtagaactaaagtacgaaacacggaccgtaggaacgaacggaacggaacggaccggacggtacttagtaacttacgttacgtaggtacggtacgtagtacgtttacgttttacgtaagttaccgtaccgtacggtaccgtaccgggttaccccgaccccgggtacgggg

SEQ ID NO: 365545 - DNA, 613 bp, Homo sapiens
  misc_feature: GZ8MTXP02JH5ZO.45.63.F08.1.454.CMB.2.raw
  modified_base (271)..(271): a, c, t, g, unknown or other
  modified_base (298)..(298): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcagcctctggacttcccccttnaatagctatagcatgaacgtgggtccnccaggcctccgaggggagggctggcgttgggttcatactattagtactagtagtacgtaccatatactacgcagactcgtgtaggaacggggcctattccaacctatacctaccgaagaacgaacaatcgacaaacgaactacactagtactcgtagaacaaagtcgaaacagacctagaggacgacggaaggaccgacgggtactaggtaattacgttacgtaggtacggacggtaggtaagtttacttttcggtaagttaaccgtaccgtacggccgttaccgggtttaccccggacccgggttacccggggg

SEQ ID NO: 365546 - DNA, 528 bp, Homo sapiens
  misc_feature: GZ8MTXP02FSZJ6.45.63.F08.1.454.CMB.2.raw
  modified_base (492)..(492): a, c, t, g, unknown or other
  modified_base (505)..(505): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggacttccccttcaatagctatagcatgaactggtccgccaggctccgagggaggggctggcgtgggtttcatacagttagtactagtagtagtacccatatactacgcagactctgtgaagggccgattcaccatctccagagacaatgaccaagactcactgtatctgacaaatgaacagcctagagagacgaaggacacggatgtaatatacgtgtagcgagtagtacgttttgnggtactcgacgtntacgggtccgacccggtacgggg

SEQ ID NO: 365547 - DNA, 564 bp, Homo sapiens
  misc_feature: GZ8MTXP02HEDR9.45.63.F08.1.454.CMB.2.raw
  modified_base (369)..(369): a, c, t, g, unknown or other
  modified_base (471)..(471): a, c, t, g, unknown or other
  modified_base (497)..(497): a, c, t, g, unknown or other
  modified_base (509)..(509): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggtttccttgttgctattttagaaggtgtcagtgtgaggtgcagctggtggagtcgtgggggaggcttggtacagccgtggggggtccctgagactctcctgtgcagcctctggtacttccccttacaatagctatagcatgaactgggtccgccgaggctccgaggggaggggctggcgttgggttcatacagttagtactagtagtagtacccatactactacgnagactctgtagaaacgggccgaattccaacctattcctaccgaaagaacgaacaaatcgacccaaagaaacctcaactgtaatcctagactaaaatgaaacnggaccagagagacggagtacacggtntagtatattacngtgacgagtacgttgtttcgaagttacacgagtacgtacggtccgacccggtggg

SEQ ID NO: 365548 - DNA, 602 bp, Homo sapiens
  misc_feature: GZ8MTXP02HQ75P.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttcccctcaatagctatagcatgaacgtcgggtcccgccgaggcctaccggaggggaacggggcgtgggcggtttcggggtttacagttactagtttaagtactagtagtagtaccccatatactacgcagtactcgtgtaggaacgggccgtattccacctatcctaccagaagacaatgaccaaagacctcactgtatctagacaaagtagaaacagacctagaagacggacggaaggaaccgacggagtacgttaatacgtttaagcgtggacgagtacgttaatttttcggaattaacgtccgtaggacgttacggtcccgtaccccggtaccggggg

SEQ ID NO: 365549 - DNA, 534 bp, Homo sapiens
  misc_feature: GZ8MTXP02FJQS7.45.63.F08.1.454.CMB.2.raw
  modified_base (492)..(492): a, c, t, g, unknown or other
tcagacgcgatcgacacgaccggtgctcgatttagcgatcgtataaggggagagaggtgccttagccctggattccaaggcatttccacttggtgatcagtactgaacacagaggactcaccatggagttggggctgtgctgggttttccttgttgctattttagaaggtgtccagtgtgaggtgcagctggtggagtctgggggaggcttggtacagccgtggggggtccctgagactctcctgtgcagcctctggattccccttcaatagctatagcatgaactggtccgcaggctaccgaggggaagggctggcgtgggtttcatacattagtactagtagtagtacatatactagcagactctgtgaaggcatcacatctccagagacaatcgaccaaagactcactgatctagacaaatgaacagcctagaacgagaacgagacaggactagtatacttacgagtcgacggaagtagttactttcgngtaactccgagtctagggttcccgacccggtgggaaccccgg

SEQ ID NO: 365550 - DNA, 531 bp, Homo sapiens
  misc_feature: GZ8MTXP02FKMNO.45.63.F08.1.454.CMB.2.raw
  modified_base (501)..(501): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttcccccttcaatagctatagcatgaactgggtccgccaggctccgaggggaaggggctggcggtgggtttcatacattagtactagtagtagtaccccatatactacgcagactctgtgaagggccgattcacatctccagagacaatgaccaaagaactacactgtatctgacaaatgaacagcctagagaagacgaaggacacggctagtaatacttatgtgacgagtagtatttcgngtactcagcgtacggtccgacccgtcgggg

SEQ ID NO: 365551 - DNA, 525 bp, Homo sapiens
  misc_feature: GZ8MTXP02FIGME.45.63.F08.1.454.CMB.2.raw
  modified_base (492)..(492): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttgggtacaggcctggggggtccctgagactctcctgtgcagcctctggactttccccttcaatagctatagcatgaactgggtccgccaggctccgagggaggggctggcgtgggttcatacattagtactagtagtagtaccccatatactacgcagactctgtgaaggccgattcaccatctccagagacaatgaccaagaactcactgtatctgacaaatgaacagcctgagagacgaggacacggtctagtatattactgtgcgagtagtattttcgngtaactccagcaaggttcccgacccgtcggggg

SEQ ID NO: 365552 - DNA, 590 bp, Homo sapiens
  misc_feature: GZ8MTXP02JJ6SR.45.63.F08.1.454.CMB.2.raw
  modified_base (272)..(272): a, c, t, g, unknown or other
  modified_base (417)..(417): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcagcctctggtaccttcccctanaatcgctatagcatgacgtcggtccgccgaggcctacggaggggacgggcgtggtcggttggttacactactattacgtactagtagtacgtaccctatactactacgacacgtactgtaggacggaacgggcctacttcacctntccacgaagacgacaatcgaacaagactactactgtactacagaacaaatacgaacacgacgtagagacgacggacgacgacggtatagtaattacgttagtaggtacgacgtagtacgttacgtttacgaacgtacgtaccgacgtcgtaccgggtcccgacccggtcgggg

SEQ ID NO: 365553 - DNA, 537 bp, Homo sapiens
  misc_feature: GZ8MTXP02F9FF8.45.63.F08.1.454.CMB.2.raw
  modified_base (254)..(254): a, c, t, g, unknown or other
  modified_base (268)..(268): a, c, t, g, unknown or other
  modified_base (293)..(293): a, c, t, g, unknown or other
  modified_base (505)..(505): a, c, t, g, unknown or other
  modified_base (510)..(510): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctcctgtgcagcctntggacttccccttnaatagctatagcatgaactggtccncaggctcgagggaggctggcgtgggttcatacagttagtactagtagtagtaccccatatactacgcagactcgtgtaggaagggccgtattcaccatctccagagacaatcgaccaagactacactgtactctagtacaaatgaacacgacctagagagacggaggacacgggctagtattattacgtgtagacgagtacgtagttttcgngtacncgtagcgtacggtccgacccgtcgggg

SEQ ID NO: 365554 - DNA, 551 bp, Homo sapiens
  misc_feature: GZ8MTXP02JV0D5.45.63.F08.1.454.CMB.2.raw
  modified_base (270)..(270): a, c, t, g, unknown or other
  modified_base (296)..(296): a, c, t, g, unknown or other
  modified_base (457)..(457): a, c, t, g, unknown or other
  modified_base (496)..(496): a, c, t, g, unknown or other
  modified_base (515)..(515): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctggagactctcctgtgcagcctctggacttccccttnaatagctatagcatgaactgggtccnccaggctccgagggagggctggcgtgggttcatacattagtactagtagtagtacccatatactacgcagactcgtgtaggaacgggccgattcaaccatccctaccgagacgaacaaatcgacccaaagaacctcaactgtaatctgacaaaatgaaacngacctagaggagaccggagaccacggctagtatattacngtgacgagagtattttcgngtactccagcgtacggtttacccgacccgtacgggg

SEQ ID NO: 365555 - DNA, 546 bp, Homo sapiens
  misc_feature: GZ8MTXP02G8957.45.63.F08.1.454.CMB.2.raw
  modified_base (254)..(254): a, c, t, g, unknown or other
  modified_base (405)..(405): a, c, t, g, unknown or other
  modified_base (410)..(410): a, c, t, g, unknown or other
  modified_base (437)..(437): a, c, t, g, unknown or other
  modified_base (439)..(439): a, c, t, g, unknown or other
  modified_base (442)..(442): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctcctgtgcagcctntggtacttcccctcaatagctatagcatgaacgtgggtccgcgaggctccgagggaaggggctggcgtggtttcatacattagtactagtagtagtacccatatactacgcagactctgtagaagggccgattcacctatcctccaagganacaanacgacaacgaaacacactagtatatananaanaagaacacgacgagagagaacgacggacgacgacgtagtatatatgagacgagtagtagtttacgttgtactacgacgacgtacggtaccggtacccggtacgg

SEQ ID NO: 365556 - DNA, 552 bp, Homo sapiens
  misc_feature: GZ8MTXP02HQNH3.45.63.F08.1.454.CMB.2.raw
  modified_base (439)..(439): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcagcctctggacttccccttcaatagctatagcatgaactgggtccgccaggctccgagggaagggctggcgtgggtttcatacattagtactagtagtagtacccatatactacgcagtactctgtgaaagggccgattcacatcctccagagacaatgacaagaactcaactgtaatctgacaaatanaacagcctggaagagacggaggaccacggctgtactaattacgtgtgacgtagtacgttaattttcggtaagtactaccgtaggcgtaaccggttccgaaccccggtcggggg

SEQ ID NO: 365557 - DNA, 653 bp, Homo sapiens
  misc_feature: GZ8MTXP02FZ7YO.45.63.F08.1.454.CMB.2.raw
  modified_base (294)..(294): a, c, t, g, unknown or other
  modified_base (321)..(321): a, c, t, g, unknown or other
  modified_base (398)..(398): a, c, t, g, unknown or other
  modified_base (404)..(404): a, c, t, g, unknown or other
tcagacgcgatcgacacgaccggtgctcgatttagcgatcgtataaggggagagaggtgccttagccctggattccaaggcatttccacttgttgatcagcactgaacacagaggactcaccatggagttggggctgtgcttgggttttccttgttgcttattttagaaggtgtccagtgtgaggtgcagctgggtggagtcggtgggggaggtcgttgggtacacggccggttcggggggtccctggacgtacctctccgtgtcgcacgtccctcgtcggactttcccccttnaatagctatagcatgaacgtgggtccnccgaggcctccgaggggaagggcgtggcggttgggttcatactagttagtactagtagtagtacccatatactacgnagactntagtagaacggccgattcacactcctaccagagaacaatcgaaccaacgtaaactccgtacttagtaactcgtagactaaaagtacgaaacgacgtaccgaggaaagacggaacggaaacggacgaacggtacgttagtaaacgttaatttaccgtggttacggacggtaacgttagttcgtttttaccggtaaggttactacgtacggacggtttaaccggtcccggtacccgggttaaccccggggg

SEQ ID NO: 365558 - DNA, 603 bp, Homo sapiens
  misc_feature: GZ8MTXP02HF8PS.45.63.F08.1.454.CMB.2.raw
  modified_base (278)..(278): a, c, t, g, unknown or other
  modified_base (413)..(413): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgcttattttagaaggtgtccagtgtgaggtgcagctggtggagtcggtgggggaggtcttgggtacaggccgtggggggtccctgagactctcctgtgcagcctcgtcggactttcccccttnaatagctaatagcatgaacgtcgggtcccgccaggcctccgaaggggaggggctggcgttgggttcattacatttagtactagtagtagtacccatatactacgcagactcgtgtagaacgggtccattcacctntcctccagacgaacaatcgaccaaagaactcaactgtactacgtagaacaaagtacgaaacacggccctaaggaacgaacggaacggaaacggaccgaacgggtactaggttaattacgtttagtgtagacgtagtacgttattttcggaagttactcgagtccgtacggttcccggtacccggacgggg

SEQ ID NO: 365559 - DNA, 569 bp, Homo sapiens
  misc_feature: GZ8MTXP02HTSW4.45.63.F08.1.454.CMB.2.raw
  modified_base (274)..(274): a, c, t, g, unknown or other
  modified_base (373)..(373): a, c, t, g, unknown or other
  modified_base (427)..(427): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctgggtggagtcgtggggggaggcttgggtacaggccgtggggggtccctgagactctcctgtgcagcctctggacttcccccttnaatagctatagcatgaactgggtccgccaggctccgaggggaggggctggcgtgggtttcattacatttagtactagtagtagtacccatatactacgnagctctgtaggaacggccgtattcaccatctccagagacaatcgaccaagaacncactagtactctagacaaaatgaaacacgaccagaacgagaacgacggacacggtctagtacttattacgtgtcgacgtagtagttacgtttttcgtaagttactaccgtagccgtacggttcccgtaccccggtacggggg

SEQ ID NO: 365560 - DNA, 733 bp, Homo sapiens
  misc_feature: GZ8MTXP02H2YBJ.45.63.F08.1.454.CMB.2.raw
  modified_base (278)..(278): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggaggcttgggtacaggccgtggggggtccctggagactcctcctgtgcacgcctcgtggtactttcccccttanaatagctatagcagtacgtaacgtcgggtccgccgaggtccgtaccgggaaggggacggggtcgtgggtcggttgggttacatacgtagttaagtaacgttagtaagtacgtaaccctaattaactaaccgtacgacacgtacttcgtagggtacgggaacggggtaccctacttaccacctactcctaccgaagaacgaactaaacgtacgaaccgaaacgtaacctactaacttagtacttacgtacgaaactaaaacgtacgaaaccacggtaccgtaaggaacggaacggaacgggtaacgggaaccgtaaccgggtacgttacggttaaacgtttacgttacgtaggttacggacggtaacggttaaacggtttacgtttttacggtaacgttacgttaaccggacggttccggttaaccgggttaccccggtaccccgggtaccggggg

SEQ ID NO: 365561 - DNA, 576 bp, Homo sapiens
  misc_feature: GZ8MTXP02I3YI8.45.63.F08.1.454.CMB.2.raw
  modified_base (268)..(268): a, c, t, g, unknown or other
  modified_base (293)..(293): a, c, t, g, unknown or other
  modified_base (548)..(548): a, c, t, g, unknown or other
  modified_base (553)..(553): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttcccctnaatagctatgcatgaactgggtccnccgaggcctcgagggaggggctggcgttgggttcatacattagtactagtagtagtacccatatactacgcagaccttgtgtacggaaacgggtcccgtaattcccaacctaacttccacccgaaggaagaaacaagtcgaaaccctaagaaactcgaactgtaactgtacgacaaattgaaactcgacctagaagaggacgtaaaggcgacggtctagtatacgttagtgtacgagtacgtacgttagtttcgngtaanctacgcgtacgtccgacgtcggg

SEQ ID NO: 365562 - DNA, 592 bp, Homo sapiens
  misc_feature: GZ8MTXP02H5RXO.45.63.F08.1.454.CMB.2.raw
  modified_base (259)..(259): a, c, t, g, unknown or other
  modified_base (275)..(275): a, c, t, g, unknown or other
  modified_base (305)..(305): a, c, t, g, unknown or other
  modified_base (387)..(387): a, c, t, g, unknown or other
  modified_base (439)..(439): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagttctggtgaaggtctggggggagcttgggtacaggccgtggggggtccctgagactctcctgtgcagcctntggtacttcccccttnaatagctaatagccagtgaacgtgggtccnccgaggcctaccggaggggaggggctggcggttgggtttcattactaattagtactagtagtagtaccccatactacacgtnagactctgtagaacgggcctaattccactactcctaccgaagacgaacaaangaaccaaagaactcacttgtaactcgttagactaaatagaacagtcagaacacggacgaggacctaggctagtaactaagttcagtcgacggtagacgttagttttgtaacgtactaccgtaggacctcgggttacccgacccgtaccggggg

SEQ ID NO: 365563 - DNA, 574 bp, Homo sapiens
  misc_feature: GZ8MTXP02I4Y9K.45.63.F08.1.454.CMB.2.raw
  modified_base (301)..(301): a, c, t, g, unknown or other
  modified_base (413)..(413): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggtacttccccgttcaatacgctatagcatgaacgtcgggtcccnccgaggcctccggaaggggaggggctggtcggtgggtttcatactattagtactagtagtagtacccatatactacgcagactgtgtagaagggccatcactatccacaganacaatcgaccaagaactcgactagtactcgtagactaaaatcgaaacagacctagacgaggacgaaggacgacggtctagtaactattacgtagtcgacgtagtagttagtttacggaagttactacgtacgcgttacggttcccggaccccgtacggggg

SEQ ID NO: 365564 - DNA, 596 bp, Homo sapiens
  misc_feature: GZ8MTXP02G0LOB.45.63.F08.1.454.CMB.2.raw
  modified_base (257)..(257): a, c, t, g, unknown or other
  modified_base (271)..(271): a, c, t, g, unknown or other
  modified_base (297)..(297): a, c, t, g, unknown or other
  modified_base (366)..(366): a, c, t, g, unknown or other
  modified_base (372)..(372): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgcttattttagaaggtgtccagtgtgaggtgcagctggtggagtcgtgggggaggcttggtacaggccgtggggggtccctgagactctcctgtgcagcctntggtacttcccctnaatgctatagcatgaacgtgggtccnccaggctccgaggggagggctggcggtggtttcatacattagtactagtagtatacccatatactacgnagactntgtagaacgggccatcacatcacagacacaatcgacaagacctcaactgtactcgtagaactaaaagtgaaaacctgggaccctagggaacggaggtaaccggaacgggacctaacgggggtacttaggttaaattacgttaccgtaggacggtacgtaacgtagtttactttttcggaagttacaccgacgtcgtaaccgggttcccggaccccgtacggggg

SEQ ID NO: 365565 - DNA, 632 bp, Homo sapiens
  misc_feature: GZ8MTXP02ID5CI.45.63.F08.1.454.CMB.2.raw
  modified_base (277)..(277): a, c, t, g, unknown or other
  modified_base (282)..(282): a, c, t, g, unknown or other
  modified_base (287)..(287): a, c, t, g, unknown or other
tcagacgcgatcgacacgaccggtgctcgatttagcgatcgtataaggggagagaggtgccttagccctggattccaaggcattttccacttggtgatcagcactgaacacagaggactcaccatggagttggggctgtgctgggttttccttgttgcttattttagaaggtgtccagtgtgaggtgcagctggtggaggtctggggggagcttggtacagccgtggggggtccctgagactctcctgtgcagcctctggaattccccccttttaanaatanactanagacatagacgtcggtccgccgacggcgtaccggaggggaaggggcggtggtcggttgggttacgtatactaagttaagtaactaagtagtacgtacctaataatactacacactactctgtaggacggacgtactacacactacctacaagaagaacaactacgacgaaacaactactactagtatactagtaacaaataagaacgacgtacgtacgaaggaaggaacggaacggaacgacgtacgttagttaacgttaacgttacgtacgtaggtacggtacgtacgttagtttacgttaagttacgtacgtacgtacgtacggttaccggtacccggtcggg

SEQ ID NO: 365566 - DNA, 745 bp, Homo sapiens
  misc_feature: GZ8MTXP02JXFLH.45.63.F08.1.454.CMB.2.raw
  modified_base (283)..(283): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgcttattttagaaggtgtccagtgtgaggtgcagctggtggagtcggtgggggagtcttgggtacaggccggtggggggtccctggacgacctctcctgtcgcacgcctcgtcgtacttcccccttanaagtagctaatagctagtacgaacgtcgggtcccgccgaagggcctaccgggaaggggacggggtcgtggggtccggtttggggtttaccaagttaccgtaagtttacggtaacgttaggttaacggtaactaacccctaattaactaccgtaacgctaagtaccttcgtgggtaacggaacggggtccctattacccgaacctacgtcctaccgaagaacgaactaagtcgaaccaaagtaacctactaacgtagttactacgtagtaaacctaaaagtcgaaaccgtcgtaccgtaaggaacggaacggaacgggaacggaccgtaaccggtgttaaggtacttaacggttacgtggtaccggacggttaagtaacgttttacgttttacgaacgttaaccgtaccggtacggtacccggtttaccggtttaacccccggaccccgggttaacccggggg

SEQ ID NO: 365567 - DNA, 538 bp, Homo sapiens
  misc_feature: GZ8MTXP02I10HT.45.63.F08.1.454.CMB.2.raw
  modified_base (294)..(294): a, c, t, g, unknown or other
  modified_base (435)..(435): a, c, t, g, unknown or other
  modified_base (470)..(470): a, c, t, g, unknown or other
  modified_base (496)..(496): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttccccttcaatagctatagcatgaactggtccnccaggctccgagggagggctggcgtgggttcatacattagtactagtagtagtacccatatactacgcagactctgtgaagggccattcaccatctccagagacaatcgaccaagaactcactgtatctgacaaatgaacngacctagagagacgagacgacgctgtaatattacngtagacgtagtacgttagttttacgngttaactcccgagtccgtacggttaccgaccccggtcggggg

SEQ ID NO: 365568 - DNA, 546 bp, Homo sapiens
  misc_feature: GZ8MTXP02ITRRU.45.63.F08.1.454.CMB.2.raw
  modified_base (296)..(296): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctgggtggaggtcgtgggggaggcttggtacaggccgtggggggtccctgagactctcctgtgcagcctctggattccccttcaatgctatagcatgaactgggtccnccaggcctccgagggaggggctggcgttggggtttcatacattagtactagtagtagtaccccatatactacgcagactctgtgaagggccattcacctatctcagagacaatgaccaagaactcactgatctagacaaagtgaaacagcctagagagacgaggacacgggctaggtactattacgtgtgacgtagtagtacttttcgaagttactccgtagcgtaacgggttccgaacccggtacgggg

SEQ ID NO: 365569 - DNA, 558 bp, Homo sapiens
  misc_feature: GZ8MTXP02H06IE.45.63.F08.1.454.CMB.2.raw
  modified_base (372)..(372): a, c, t, g, unknown or other
  modified_base (414)..(414): a, c, t, g, unknown or other
  modified_base (495)..(495): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgctattttagaaggtgtccagtgtgaggtgcagctgggtggagtcgtggggggagcttggtacagccgtggggggtccctgagactctcctgtgcagcctctggacttccccttcaatagctatagcatgaactgggtccgccaggctccgaggggaggggctggcgttggggttcagtactattagtactagtagtagtacccatactactacgnagactcgtggtagacgggccgtattccaccactcctccaganacaatgaccaaagacacgactgtaatctgacaaattagaacacgacctagagagacggagaccgacgctagtatattacgngtgacgagacgttattttcgtgtacttacgcgtaccgacggtttacccggacccgttcggggg

SEQ ID NO: 365570 - DNA, 688 bp, Homo sapiens
  misc_feature: GZ8MTXP02I9YT5.45.63.F08.1.454.CMB.2.raw
  modified_base (218)..(218): a, c, t, g, unknown or other
  modified_base (454)..(454): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatgggagttggggctgtgctgggttttccttgttgctattttagaaggtgtccagtgtgaggtgcagctggtggaggtcgtggggagcttggtacngccgtggggggtccctgaggactctcctgtcgcagcctcgtcggtacttccccttacaatagctatagcagtgaacgtggcccgcgaggcctacggaggggacgggcgtaggtcggttcgggttactatactaagttacggtactaagtaggtactaaccgtatactacgtacgcacgtactcgagttaggaaaccggtcgtattaccgaacctatacctacccgaagaaaccgtnaaacgaaacgtaccgcccaaacgtaacgtacctacgttacgttaactaacgtacggaacgtaaacgtacgtaaacgaacgtaccgtaacggaacggaacggaacggaacggtaacgtaacggtacgttacgttaacgttaacgttacgtacggtacggtacgtacggtaagttacgtttaacggttacggttacgtaccgtaccggtaccggtacgggtacccggtaaccccgg

SEQ ID NO: 365571 - DNA, 580 bp, Homo sapiens
  misc_feature: GZ8MTXP02FTF0U.45.63.F08.1.454.CMB.2.raw
  modified_base (267)..(267): a, c, t, g, unknown or other
  modified_base (293)..(293): a, c, t, g, unknown or other
  modified_base (545)..(545): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggacagccgtggggggtccctgagactctcctgtgcagcctctggacttccccttnaatagctatagcatgaactgggtccncaggctccgagggaggctggcgtgggttcatacattagtactagtagtagtaccatatactacgcagctcgtgtaggaacgggccgtattccaaccgtatcctaccgaagagaacaatcgaccaaacgtaactctaaccttagtaacttccgtagaactaaaagtcgaaacaggaccctaaggaagacggacggaacggaccgacgggtcttagtaattagttaacgtgtagcgtaagtacgtgttttacgngttactcacgcgtacggtcccggaccggtacgggg

SEQ ID NO: 365572 - DNA, 564 bp, Homo sapiens
  misc_feature: GZ8MTXP02F9H33.45.63.F08.1.454.CMB.2.raw
  modified_base (274)..(274): a, c, t, g, unknown or other
  modified_base (300)..(300): a, c, t, g, unknown or other
  modified_base (415)..(415): a, c, t, g, unknown or other
  modified_base (459)..(459): a, c, t, g, unknown or other
  modified_base (481)..(481): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggtcttgggtacaggccgtggggggtccctggagactctcctgtgcagcctctggacttcccccttnaatgctatagcatgaacgtgggtccnccgaggctccgaggggaggggctggcgttgggttcagtacattagtatagtagtagtacccatactactacgcagactcgtgtaggaagggccgtattcacctatcctccaaganacaatcgaaccaagaactcactagtactactagacaaatgaacngctagagagacgaggacacggntagtaatattacgtgtacggacgtagtagttcgttttagaagttactaccaggtccgtacgggttcccgacccggtccggggg

SEQ ID NO: 365573 - DNA, 618 bp, Homo sapiens
  misc_feature: GZ8MTXP02IAKCV.45.63.F08.1.454.CMB.2.raw
  modified_base (273)..(273): a, c, t, g, unknown or other
  modified_base (280)..(280): a, c, t, g, unknown or other
  modified_base (282)..(282): a, c, t, g, unknown or other
  modified_base (298)..(298): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagctggtggagtcgtgggggagtcttggtacagccgtggggggtccctgagactctctgtgcagcctcgtggtacttccccttanatgctananctatcgacgtcggccncgaggctacggaggggacggtcgtggtcgttggttacagtactagttacgtagtagtacgtactacctatactacacgacagtactcgtagtaggaccggtcctataccaactctcctacgagaacactaacacgaactaaacgactactacgtatactactagaaactaaagtagaacacgacgtagaacggaacggaaggtaacggaccgacggtacttaagttaacttacgtacgttgacggtacgtaagttacgtttaacgtttcgtaagttacctacgtacgtaccggttaccggtaccccggtaccgggtcggg

SEQ ID NO: 365574 - DNA, 737 bp, Homo sapiens
  misc_feature: GZ8MTXP02GCNZ3.45.63.F08.1.454.CMB.2.raw
  modified_base (272)..(272): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgcttattttagaaggtgtccagtgtgaggtgcagctggtggagtcgtgggggagcttggtacaggccgtggggggtccctgagactctcctgtgcagcctctggacttcccccttanaatagctatagacatacgtaacgtcgggtccgaccgaggctaccggaaggggaggggtcgtgggtcggttagggttacaattacgtaagtttaagtaacgttaagtaacgtaacgtaaccctaattaactaactacgacaagtaccttgtaggtaggaacggggtacctattaccaacctactacctaccgaaagaacgaaactaaacgtacgaaaccgaaacgtaaacctacgtaacttacgtaacttaccgtacgaaactaaaacgtaacgaaacctaacggtaccgtaaggaaacggaaacggaacgggaaacggaaccgtaacgggtacgttaagttaaactttaacgtttaacgtacggtacggaacggtaaggttaacgtttacgtttttacggtaacgttaaccgtaccgtaacggtaccggttaaccgggttaccccggtacccccggggtacgggg

SEQ ID NO: 365575 - DNA, 625 bp, Homo sapiens
  misc_feature: GZ8MTXP02IQTT4.45.63.F08.1.454.CMB.2.raw
  modified_base (299)..(299): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacaggccgtggggggtccctgagactctcctgtgcagcctcgtggacttccccttacaatgctatagcatgaacgtgggtcccnccgaggcctccgaggggaggggctgggcgttgggttcatactattagtactagtatagtaccctatactactacgcacgctcgtgtaggaaacgggcctaattccgaacctattcctacccgaggtaagaacaagtacgaccaacgaacttcaacttagtacttacgtagaactaaagtacgaaaccagacccgtaggaaggtaacggacggaacggaccgacggtcttaggtaattacgttacgtggtacgacggtagtaaggttgtttttacggaagttaacgtcgtagaccgtaacgggttcccggaaccccggttccggggg

SEQ ID NO: 365576 - DNA, 724 bp, Homo sapiens
  misc_feature: GZ8MTXP02HJ7QP.45.63.F08.1.454.CMB.2.raw
  modified_base (289)..(289): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgcttattttagaaggtgtccagtgtgaggtgcagctgggtggaggtcggtggggggaggtcgttgggtacaggccggttgggggggtccctggagactctccgtgtcgcagtcctcgtggtactttccccttanaatagctatagcatgaacgtgggtccgccaggctccgaggggagggctggcgttgggttcatactattagtactagtagtagtacccctatatactacgcagtactcgtggtaggaacggggtcctacttccaacctacttaccctaccgaacggtaacgaaacccaaagttacccgaaaccctaaaacggtaaaccttacccgtaacctttaggtacttacctaaacggtacctaaaaagttaacgggaaacctaacggacccgttaaggaaacgggaaacggacccgggaagggaaccgacgggtacgttaagttaaactttagtttaaaccgtggttacggacggtaacgttaaggtttacgtttttacgtaacggttactacccggtaggtaccggttacgggttacccccggtaccccggttaccggggg

SEQ ID NO: 365577 - DNA, 664 bp, Homo sapiens
  misc_feature: GZ8MTXP02JA36G.45.63.F08.1.454.CMB.2.raw
  modified_base (469)..(469): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggaggtcttggtacagccgtggggggtccctgacgactctcctgtgcagcctgtggtacttcctcttcaatagctatagcatagaacgtcgggtcccgccgaggcctaccggaagggggaacggggcgtagggtcggttggggtttacaagtaactagtttaagtactagtagtaacgtaccaatactactacgacaagcctgtagtaggaacggacctattaccaccgatcctacgaagacaacaaatcgaaccaaagtaacctnacgttagtaactctacgaactaaaagtagaaaaccgagaccgtaaggaacggacggaaacggacggaaccgacggtacgttagttaaacgttaaagttaccgtaggttacggacgtaaaggttaacgtttaccgtttttaaggacgttaaacgtacgacggtaccgtaacgggtttaccccggaaacccccgggg

SEQ ID NO: 365578 - DNA, 627 bp, Homo sapiens
  misc_feature: GZ8MTXP02GJS3Y.45.63.F08.1.454.CMB.2.raw
  modified_base (264)..(264): a, c, t, g, unknown or other
  modified_base (290)..(290): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctatttagaaggtgtcagtgtgaggtgcagatggtggagtcgtgggggagcttggtacagccgtggggggtcctgagactctctgtgcagcctcgtggacttcccctnaatagctatagcatgaactgggtccncaggctccgagggacggctggcgtgggttcatactattagtactagtagtatacccatatactacgcagactcgtagtggaaacgggccctattaccaacctattcctacccgaaagaacgaaccaaatcgaacccaaaaggaacttcaacttgtaattaccgtaagaacaaacgtaacgaacgaacgacgacgaaggaacggaacggaacggaaccgaacggtacgttagttaacgttaacgttacgtacggtacgtacggtacgtaacgttaacgtttacgttaacgttacgtaccgtacgtaccgtaccggtacccggtaccccgggtaccggg

SEQ ID NO: 365579 - DNA, 544 bp, Homo sapiens
  misc_feature: GZ8MTXP02JKP2Y.45.63.F08.1.454.CMB.2.raw
  modified_base (258)..(258): a, c, t, g, unknown or other
  modified_base (297)..(297): a, c, t, g, unknown or other
  modified_base (377)..(377): a, c, t, g, unknown or other
  modified_base (450)..(450): a, c, t, g, unknown or other
  modified_base (488)..(488): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacaggccgtggggggtccctggagactctcctgtgcagcctntggacttccccttcaatgctatagcatgaactgggtccnccaggctccgagggaaggggctggcgtgggttcatacattagtactagtagtagtaccccatatactacgcagactctgngaaaggggcccagttccacctatcctccagacgacaatcgaccaagaactcaatgtatctgacaaatcgaacngactagagagacggtagacacggtctagtatagttacngtcgagacgtagttatttcggaatactccgagcgtacggttaccgaccccgtgggg

SEQ ID NO: 365580 - DNA, 759 bp, Homo sapiens
  misc_feature: GZ8MTXP02IB68K.45.63.F08.1.454.CMB.2.raw
  modified_base (282)..(282): a, c, t, g, unknown or other
  modified_base (293)..(293): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagcgtggtggaggtcgtggggggagtcttgggtacaggccgtggggggtccctgagactctcctgtgcagtcctcgtggtacttcccccttaanaatacgactanagcagtacgacgtcggtccgccgaggccgtacggaggggacgggtcgtggtcggtttcggttactagttaacgtaagtttaagtaacgttaagtacgttaacgtaacccctaagttaactaaccgtaacgactaacgtaccttgtacggtacggaaccgggtacctactacccgaacctactaccctaccgaaagaacgaactaaacgtaccgaacctaaaacgtacctactaacgttagtaactacgtagaaactaaaagtacgaaacgtacgaccgtaaggaaacgaacggtaaaccgggaacggtaaacgaccggttagttaaacgttaaacgttaacgtttacggtcggttaacggaacggttaacggtttacgtttttacgtttacggtaacggttaaccgtacccggtacggtacccggtttacccggggtttaacccccggtacccggggtaccggggg

SEQ ID NO: 365581 - DNA, 609 bp, Homo sapiens
  misc_feature: GZ8MTXP02IPOI5.45.63.F08.1.454.CMB.2.raw
  modified_base (265)..(265): a, c, t, g, unknown or other
  modified_base (460)..(460): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggagcttggtacaggccgtgggggtccctgagactctctgtgcagcctctggacttcccctnaatagctatagcatgaacgtgggtcccgccaggctaccggaggggagggctggcgttggttcagtctattacgtactagtagtagtaccccatactactacgcaacgcttcgtgtaggaacggggccctagttaccactactcctacagacgaactaagtacgaaccaacgaacttcaacgttatataccgtaanaaactaaacgtacgaacgtacgacgagaacgaggaacgacgacgacgtatagttacttacttacgtcggtacgacggtagttaacgtttacgttttaggtcgttaactccgtacggtaccggttaccggttcccggacccggtacgggg

SEQ ID NO: 365582 - DNA, 572 bp, Homo sapiens
  misc_feature: GZ8MTXP02F6GAN.45.63.F08.1.454.CMB.2.raw
  modified_base (273)..(273): a, c, t, g, unknown or other
  modified_base (298)..(298): a, c, t, g, unknown or other
  modified_base (450)..(450): a, c, t, g, unknown or other
  modified_base (500)..(500): a, c, t, g, unknown or other
  modified_base (531)..(531): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttgggtacaggccgtggggggtccctggagactctcctgtgcagcctctggacttccccttnaatgctatagcatgaactgggtccnccgaggcctcggagggagggctggtcgtgggttcatacattagtactagtagtagtacccatatactacgcagtactcgtgtaggaacggggcctattcaccgtatacctccagacgaacaatcgaccaaagtactactactagtatacgtnaaacaaagtgaaacgagtccaggaacggtaagacggaagacgaccgggtntagtattagtacgtgtagacgtagtacgttntttacgaagtactcgacgtacgtacggtaccgaccggtcgg

SEQ ID NO: 365583 - DNA, 580 bp, Homo sapiens
  misc_feature: GZ8MTXP02I75F6.45.63.F08.1.454.CMB.2.raw
  modified_base (268)..(268): a, c, t, g, unknown or other
  modified_base (293)..(293): a, c, t, g, unknown or other
  modified_base (475)..(475): a, c, t, g, unknown or other
tcagacgcgatcgacacgaccggtgctcgatttagcgatcgtataaggggagagaggtcccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtgggggtccctgagactctcctgtgcagcctctggacttccccttnaatagctatagcatgaactggtccnccaggcctccgaggggagggctggcgtgggttcatacattagtactagtagtagtaccatatactacgcagactctgtagaaaggggccattccacatcctaccagagacaatcgacccaaagacctcaactgtatctagacaaaagtcgaacagcctagaagaggacgaaggaacaccggntagtaattacgttactggtacgacgtaaggtacgttagtttttccggagttaacgtcccgaaggcccgtaacgggtttccccgaaccccggttgggggaaccccg

SEQ ID NO: 365584 - DNA, 726 bp, Homo sapiens
  misc_feature: GZ8MTXP02H88K4.45.63.F08.1.454.CMB.2.raw
  modified_base (281)..(281): a, c, t, g, unknown or other
  modified_base (580)..(580): a, c, t, g, unknown or other
  modified_base (587)..(587): a, c, t, g, unknown or other
  modified_base (631)..(631): a, c, t, g, unknown or other
tcagacgcgatcgacacgaccggtgctcgatttagcgatcgtataaggggagagaggtgccttagccctggattccaaggcattttccacttggtgatcagcactgaacacagaggactcaccatggagttggggctgtgctgggttttcttgttgcttattttagaaggtgtccagtgtgaggtgcagcgtggtggaggttcgtggggggagtcgttgggtacagccggtggggggtaccctgacgactctccgtgtgcagcctctcggtcttcccctanaatgactatgacatacggaacgtcgggtccgaccgagggccttccggaagggggaacggggtccgtggggtcggtttaggggtttactagttaacgtaagtttacgtaaacgtttaacggttaaggttaacgtacccgtaaattaacgttaacgttaaccgacgtaacgaaccgttcgtacgggtttacggaaaccgggggtacccgtacgttaccctaaccaaccttacccgttacccgaaggtaaacggacaaacgtacgtaacccgaaagtaaacctccgtaacgttagtaacttntacgtanaaactagtaacacgtcgagagaacggacgcggaacgaccgggtntaacgttattacgttagtcggtagtacggtacgttacgttagtttcgttaacgtacgtaccgtacgtcggtaccgggtcccggtacccggtcggg

SEQ ID NO: 365585 - DNA, 535 bp, Homo sapiens
  misc_feature: GZ8MTXP02FENMS.45.63.F08.1.454.CMB.2.raw
  modified_base (267)..(267): a, c, t, g, unknown or other
  modified_base (293)..(293): a, c, t, g, unknown or other
  modified_base (358)..(358): a, c, t, g, unknown or other
  modified_base (372)..(372): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagccgtggggggtccctgagactctcctgtgcagcctctggattccccttnaatagctatagcatgaactgggtccnccaggctccgagggaaggggctggcgtgggtttcatacattagtactagtagtagtaccccatanactacgcagactcngtgaagggccattcaccatctccagagacaatgaccaagaactcactagtatctgacaaatgaaacagcctagaggagacggagacacggctagtatattactgtgcgagtagtattttcgaagttactccgagccgtaagggttcccgaccccgtacggggg

SEQ ID NO: 365586 - DNA, 531 bp, Homo sapiens
  misc_feature: GZ8MTXP02H15PQ.45.63.F08.1.454.CMB.2.raw
  modified_base (391)..(391): a, c, t, g, unknown or other
  modified_base (454)..(454): a, c, t, g, unknown or other
  modified_base (458)..(458): a, c, t, g, unknown or other
  modified_base (466)..(466): a, c, t, g, unknown or other
  modified_base (471)..(471): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgctattttagaaggtgtccagtgtgaggtgcagctggtggagtcgtggggggagcttggtacagccgtggggggtccctgagactctcctgtgcagcctctggacttccccttcaatagctatagcatgaactggtccgccaggctccgagggagggctggcgtgggtttcatacattagtactagtagtagtaccccatatactacgcagactctgtgaaggggccattcaccntctcagagacaatgacaagaactcactgatctgacaaatgaacagtccagagagacgaggacncggntgtaactnttacngtcgagacgagtaagttttcgaagttactaccgagcgtacggtttcgaccccggtcgggg

SEQ ID NO: 365587 - DNA, 581 bp, Homo sapiens
  misc_feature: GZ8MTXP02HF6D9.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctatttagaaggtgtccagtgtgaggtgcagctggtggagtcgtgggggaggcttgggtacagccgtggggggtccctgagactctcctgtgcagcctcgtggacttcccccttaatagctaatagcatgaactggtccgccaggctcgagggaggctggcgtgggttcatacatttagtactagtagtagtaccccaatataactacgcaagacttcgtaggtagaaacggggtccgtattccgaacctaattccgtaccaaggagaaccagtacgcaaagtaactcaactgtactactgaccaaagttcaaacgagtacccgtgaaggacgaaggacggtacaacggtctagtattagttacgtgtagcgtagtagtacgttttgaagttacgccgtagcgtacggttaccgacccgtcgggg

SEQ ID NO: 365588 - DNA, 914 bp, Homo sapiens
  misc_feature: GZ8MTXP02IO6BK.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttcttgttgctatttagaaggtgtccagtgtgaggtgcagcgtggtggaggtcggtggggggaggtcgttagggtacacggtccggtcggggggtccctaggacgtaccttcctccgtgtcgcgacgtcctcgtcggtacttcccccttataatacgctaatacgctaatacggtaacgtcggggtccccgccgagggccctaccgggaagggggacggggtcgtggggtcggtttacggggtttccaaagttaccgtaagtttaaacgtaaccgtttaaaggtaaacggttaacggtaaacccccccttaaagttaaacgttaaacccgtaacccggtacgtaaacggttaacccgttccgggtttacgggttaaacgggggaaaacccgggggtcccttaaacgtttacccaaaaccccgttactttaccccgttaaacccggaaaggggaaaacgtaaaaccctaaaaggtttacccgaaaccccgtaaaaaacggtaacccttacccggtaaaccttagggttaccttacggttaaacggaaacctaaaaagttcgaaaaaccgttcgggacctaaagggaaacgaaacgggaaaccgggaacggaacccggtaccggggtacttaaggtttaaattaacgtttaaccgtggggtaaccggtacgggtaaacgttaggttttaacgttttaccggtaagttacccgttaaccgacgggtacccgtttaccggggtaccccggtaaaccccggggtcccgggggg

SEQ ID NO: 365589 - DNA, 530 bp, Homo sapiens
  misc_feature: GZ8MTXP02FM2HM.45.63.F08.1.454.CMB.2.raw
  modified_base (270)..(270): a, c, t, g, unknown or other
  modified_base (497)..(497): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctggggaggcttgggtacagccgtggggggtccctgagactctcctgtgcagcctctggtacttcccccttnaatagctatagcatgaactgggtccgcaggctccgagggagggctggcgtggttcatacattagtatagtagtagtaccccatatactacgcagactctgtgaagggccgattcaccatctaccagagaacaatcgaccaaagaactacactgtatctgacaaatgaacagcctgagagacgacggacacggctagtattacttactgtagcgagacgtattttcgngtatccagccgtacggtcccgaccccgtcgggg

SEQ ID NO: 365590 - DNA, 520 bp, Homo sapiens
  misc_feature: GZ8MTXP02JGJAX.45.63.F08.1.454.CMB.2.raw
  modified_base (254)..(254): a, c, t, g, unknown or other
  modified_base (267)..(267): a, c, t, g, unknown or other
  modified_base (289)..(289): a, c, t, g, unknown or other
  modified_base (383)..(383): a, c, t, g, unknown or other
  modified_base (392)..(392): a, c, t, g, unknown or other
  modified_base (429)..(429): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctatttagaaggtgtccagtgtgaggtgcagctggtggagtcgtgggggaggcttggtacagccgtggggggtccctgagactctcctgtgcagcctntggattccccttnaatgctatgcatgactggtccnccaggctcgagggagggctggcgtgggttcatacattagtactagtagtacgtacccatatactacgcagactcgtgagaagggccgattcacntcctcaganacaatgacaagactcatgtatctgacaaagtgaaacngcctagagagacgagacaggctgtactatactgtgcgtagtagtattttcgaagtactaccgagtcgtacgggttccgacccgtacggggg

SEQ ID NO: 365591 - DNA, 615 bp, Homo sapiens
  misc_feature: GZ8MTXP02IVMD4.45.63.F08.1.454.CMB.2.raw
  modified_base (271)..(271): a, c, t, g, unknown or other
  modified_base (429)..(429): a, c, t, g, unknown or other
  modified_base (478)..(478): a, c, t, g, unknown or other
  modified_base (512)..(512): a, c, t, g, unknown or other
  modified_base (571)..(571): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctatttagaaggtgtccagtgtgaggtgcagctggtggagtcgtgggggaggcttggtacagccgtggggggtccctgagactctcctgtcgcagcctctggtacttccccgtanaatagctatagcatgaacgtgggtccgaccaggctaccggaggggacggcgtggtcggttggttcagtactattagtaactagtacgtactacccctatactacacgcacgtactcgtagtaggaacgggtccctattccacgtactacctcaagganaacaagtcgaccaaagtactcaactagtatactagacaaagtcgaaacncgtaccagacgacgacggaaacggcgtaccggtnttaaggtaactttagttaaccggtgtaaccggacgtaagtacgtttagttttaccggtnaacctccgaacgccgtaacgggtttcccgaacccgggtccgggg

SEQ ID NO: 365592 - DNA, 1043 bp, Homo sapiens
  misc_feature: GZ8MTXP02G0PHA.45.63.F08.1.454.CMB.2.raw
  modified_base (784)..(784): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgcttgggttttccttgttgcttattttagaaggtgtccagtgtgaggtgcagcgtgggtggaggtcggtggggggaggtcgttgggtacgacggtcccggttcgggggggtcccctggacgtaccttccttccgtggtcgcacgtccctcgtcggtacctttccccccgttacaaagtacgccttaatacggcctaagtacggaaaccgttcggggtccccgcccgaacgggtccctaccccggggaagggggggaacgggggtccgttgggggccggttttacgggggttttaccaaacgtttaaaccgttaaggttttaacggttaaaccgtttaaaggggttaaacggtttaaaccggtttaaacccccccttaaaatttaaaaccgtttaaaccccgttaaccgggtaaccgtaaaccggttaaccctttccgggtttacggggttaaacgggggaaaacccgggggtccccgttaaacttttacccccgaaacccgttaaaccctttaccccgttaacccgaaaggtaaaccggaaaacctaaacgttacccgaaaaccccgtaaaacggtaaacccttacctaaaccgtttggttaaaccttaccgttaacggaaaaccctaaaagttaccgaaaacccncggtaaccccgtaaagggaaacggtaacgggaaaccgggaaacggggtaaccccgaaccgggggttacttaaacggtttaaacgtttaaacgttttaaaccggttgggtaaccgggtaacgggtaaggtttaaaccggttttagttttttaacccgggtaacgggtttaaaacttaccccggggtaaacgttaccccggggtttaaaccccggggtttacccccggggtaaaacccccgggggtttacccccggggggg

SEQ ID NO: 365593 - DNA, 540 bp, Homo sapiens
  misc_feature: GZ8MTXP02FG2OC.45.63.F08.1.454.CMB.2.raw
  modified_base (270)..(270): a, c, t, g, unknown or other
  modified_base (449)..(449): a, c, t, g, unknown or other
  modified_base (479)..(479): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttgggtacagccgtggggggtccctggagactctcctgtgcagcctctggattccccttnaatagctatagcatgaactgggtccgcaggctccgagggagggctggcgtgggtttcatacattagtactagtagtagtaccccatatactacgcagactctagtgaaaggggccattcaccatctccagagacaatgaccaaagaactcatgtatctgacaaatgaaccagcctgganagacgaggaccacgggctgtaaatattacngtgacgaagagtagtttcgaagtacgtcccagtcctagggttccccgaccccggtcggggg

SEQ ID NO: 365594 - DNA, 644 bp, Homo sapiens
  misc_feature: GZ8MTXP02HAMXR.45.63.F08.1.454.CMB.2.raw
  modified_base (281)..(281): a, c, t, g, unknown or other
  modified_base (289)..(289): a, c, t, g, unknown or other
  modified_base (310)..(310): a, c, t, g, unknown or other
tcagacgcgatcgacacgaccggtgctcgatttagcgatcgtataaggggagagaggtgccttagccctggattccaaggcattttccacttggtgatcagcactgaacacagaggactcaccatggagttggggctgtgcttgggttttccttgttgctattttagaaggtgtccagtgtgaggtgcagcgtggtggagtcggtgggggaggtcgttggtacaggccggtggggggtccctgagactctccgtgtcgcagcctcgtcggtccttccctanatagctanagctagtacgtacgtcggccncgaggcgacggagggacggtcgtggtcggttggttacagtagtagttacgtagtagtagtactacctatactactacgatacgtacgtgtaggtacggaacggtcctactaccacctactacaccgaagaacgtaacgaacgtacgaaccgtaaacgtacctacgtacgttagtactacgtagtaaacaaagtacgaacacgtacgtaggaagacggtaacggacggtactacggtacttagttaacttacgttgtacggtgacgtaagttcgtttacgtttacgaacgttacgtcgtacggtaccgttaccggtaccccggacggtaccgggg

SEQ ID NO: 365595 - DNA, 552 bp, Homo sapiens
  misc_feature: GZ8MTXP02F9TF4.45.63.F08.1.454.CMB.2.raw
  modified_base (402)..(402): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctgagactctcctgtgcagcctctggacttccccttcaatagctatagcatgaactgggtccgccaggctccgaggggaaggggctggcgtgggttcatacattagtactagtaagtagtacccaatatactacgcaagactctgtgaagggccattcacatctccaganacaatcgaccaagaaactcaactgtatctagacaaaagtcgaacagtccagagacgacgaacggacacggactagtaacttatactacggtgacgagtagtacttttcggaattactaccaggtctacggtttcccgaccccttaggggg

SEQ ID NO: 365596 - DNA, 643 bp, Homo sapiens
  misc_feature: GZ8MTXP02HRQB3.45.63.F08.1.454.CMB.2.raw
  modified_base (274)..(274): a, c, t, g, unknown or other
  modified_base (282)..(282): a, c, t, g, unknown or other
  modified_base (287)..(287): a, c, t, g, unknown or other
  modified_base (297)..(297): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggaggtcgtggggggagtcgttggacaggccgtgggggggtccctggagactctcctgtgcagcctcgtgtacttcccctnaatgctanagcangactggtccncaggctaccgagggaggctggcgttggtcagtactatagtactagtagtagtacccattacactacgacagtactcgtaggagtaaacgggccgtaattccaaccaatcctaccgaaggacaacaagtaccgacgaaacgtaaacctacgaacttagtaactccgtaaacgtaactaaaacgtagaaaccacgacgtaagaacgtacggaacggacggtaacgacggtacgttaagttaactacgtttacggacggtaggacggttaaagtacgttttacgtttacgtaacgttacgtaaccgtacggtaccggttacccggttaccccggtacccggggtacggg

SEQ ID NO: 365597 - DNA, 684 bp, Homo sapiens
  misc_feature: GZ8MTXP02H6LX5.45.63.F08.1.454.CMB.2.raw
  modified_base (279)..(279): a, c, t, g, unknown or other
  modified_base (307)..(307): a, c, t, g, unknown or other
  modified_base (417)..(417): a, c, t, g, unknown or other
tcagacgcgatcgacacgaccggtgctcgattttagcgatcgtataaggggagagaggtgccttagccctggattccaaggcattttccacttggtgatcagcactgaacacagaggactcaccatggagttggggctgtgcttgggttttccttgttgcttattttagaaggtgtccagtgtgaggtgcagctggtggaggttcgtgggggaggtcttgggtacaggccgtgggggtccctgagactctctgtgcagcctctcggtacttccccttanaatagctatagacatagacgtgggtccnccgaggctccggagggagggctggcgttgggtttcatactattagtactagtagtagtacccatactactacgcagtactctaggtaggacgggccgtattccgaacctntcctaccagaacgaacaaactcgaaacccaaagtaacctacgtaccttagttacttactacgaacgtaaaacttacggaaacctagtacccgtaaggaaggaacggtaaccggaaggaacccgacggtacgttaaggttaactttaaagtttaaccgttggaaacggtaccggtaaagtacggtttttaacgtttttccggtaagttacccgttaccggacgttaccggtaacccgggtttccccgtacccccggggtaaccggggg

SEQ ID NO: 365598 - DNA, 634 bp, Homo sapiens
  misc_feature: GZ8MTXP02FPLKZ.45.63.F08.1.454.CMB.2.raw
  modified_base (283)..(283): a, c, t, g, unknown or other
  modified_base (561)..(561): a, c, t, g, unknown or other
  modified_base (575)..(575): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgcttattttagaggtgtccagtgtgaggtgcagcgtgggtggagtcggtgggggaggcttggtacagccgtggggggtccctggacgacttctccgtgtcgcacgtccttctggtacctttcccctanaaatagctagtacgcagtagaacgtcgggtcccgccgaggtcctcgggaaggggaaggggtcgtggggtcggttgggtttcagtacgtagtttaagtactaaggtaagttacgtaacccctattactaacgtacgcaacgtcttcgtgtacggaaacggggtcctattaccacgtacttcctaccgaagaactaccaagtccgaaccaagtaaactcgtaactagtactcgtaagaacaaagtacgacacggtccgaagagagaacggaagcacggtnttagtactagttgngtgagtacgttagttcgtttgaatacgtacgacgtccgtacggtacccgtaccggtcgg

SEQ ID NO: 365599 - DNA, 611 bp, Homo sapiens
  misc_feature: GZ8MTXP02I5Q3M.45.63.F08.1.454.CMB.2.raw
  modified_base (527)..(527): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggagcgttggtacagccgtggggggtccctgacgactctcctgtgcagcctctggacttcccctcaatagctatagcatgaactgggtccgccaggcctccgagggaaggggctaggcggttgggttcatactagttagtactagtagtagtacccctatactactacgcagactctgtggaacgggccgattcgaccatcctccaagacacaatagaccaaataaccgtacactagtacttacgtgaacaaacgttagaaactacgacctaggaacggtaagacgggaacgtaccgaacgggtctaggttaacttaattacgnggtcggaccgaaggtacgttagtttttacgaagttaaccgtacgacgttaccggacgggtttacccggaccccggttacggggg

SEQ ID NO: 365600 - DNA, 772 bp, Homo sapiens
  misc_feature: GZ8MTXP02JJH11.45.63.F08.1.454.CMB.2.raw
  modified_base (633)..(633): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgcgttggttttccttgttgcttattttagaggtgtcagtgtgagtgcagcgtggtggagtcggtgggggaggtcgttggtacgacggtccggtcggggggtccctggacgtactctcgtgtcgcacgtcctcgtcgtacctttcccccgttacaaacttacgtctaatacgactagtacggtaaccgttcggggtccccgaccgacggtccctaccgggaacggggaacggggcgttcggggaccggttttggggtttacctaacgttacttaagttttaacggtaaaccgtttaaggttaaacggttaacggtaaccccttaattaacgttaacccgtaaccgtacgtaacggttaccgttcgttacggtaaggggttaaccggggaccctaagtttcccaaacctacgtacctaccgaaacgtacgaaactaacgtacgaaccaaacgtaaacctcgtaactagtactacgtacgtaaacaaacgtacgaaacncggaaccgagaacggaacgaaccggaggaaccgtacgactttaggtacttaagttcgtagtacggtacgtagtacggtttatttcggtaacgttctaaccgtagtaccgttaccggttacccggaccggtaaccggggg

SEQ ID NO: 365601 - DNA, 655 bp, Homo sapiens
  misc_feature: GZ8MTXP02HVP8O.45.63.F08.1.454.CMB.2.raw
  modified_base (296)..(296): a, c, t, g, unknown or other
  modified_base (326)..(326): a, c, t, g, unknown or other
tcagacgcgatcgacacgaccggtgctcgatttagcgatcgtataaggggagagaggtgccttagccctggattccaaggcattttccacttggtgatcagcactgaacacagaggactcaccatggagttggggctgtgcttgggttttccttgttgcttattttagaaggtgtccagtgtgaggtgcagctgggtggaggttcggtgggggagtcgttgggtacaggtccggttggggggtccctgagtaccttccttccgtgtcgcacgtcctcgtcggtacttcccccttanaactagctatagctatagacgtcgggtccncgaggcctaccgggaggggagggtctgggtcgttcgggtttcattactatttagacttagtagtactacccatactactacgctagctctggtacgaacgggtcctaatcccaactcgttcccacgtacgaagaactaatccgacaaacgtactaccaacgttgtaactctacgaactaaagtacgacgtacgcctaaggagacggaaggtacgaacggtacgtattaacggttaattaggttaactggtacggacgtaacgtagtttaacgttttcgaacgttacgccgttaaacggccgttaacgggttcccctaccgggggaccgg

SEQ ID NO: 365602 - DNA, 597 bp, Homo sapiens
  misc_feature: GZ8MTXP02IRUTF.45.63.F08.1.454.CMB.2.raw
  modified_base (195)..(195): a, c, t, g, unknown or other
  modified_base (298)..(298): a, c, t, g, unknown or other
  modified_base (371)..(371): a, c, t, g, unknown or other
  modified_base (429)..(429): a, c, t, g, unknown or other
tcagacgcgatcgacacgaccggtgctcgatttagcgatcgtataagggggaatcagtcccactcaggacacagcatggacatgagggtccccgctcagctcctggggctcctgctgctctggttcccaggtgccaggtgtgacatccagatgacccagtctccatctgccatgtctgcatctagtaggagacanagtccaccatcacgttgtcgggcagtccgagggtcattagactaatttattagtcctggtttcagcaagaaaccgaggaaacgtccctaagccgcctgacttntatgctgctatcccgtagtttgacgtaaaggtcgggtacccatccgtaacgggttcacggcggcgtaggtggngtttcgcggggaactacggtaccttacgaccttcacgtacaacgtcgaagtcacgccncgacgacgacgtagtagttagttacgtacttaacttacttacgttacgtactacgtagtactaactaacgttacgttacgtacgttacgttacggtacggtacggtacgtacgtacgtacgacgtaacgtaacgtaacgtacgtacgtacgtacgtacgtactactac

SEQ ID NO: 365603 - DNA, 690 bp, Homo sapiens
  misc_feature: GZ8MTXP02FKRZR.45.63.F08.1.454.CMB.2.raw
  modified_base (277)..(277): a, c, t, g, unknown or other
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggaggtcttgggtacaggccgtgggggggtccctggacgactcctcctgtgcagcctcgtggactttccccttnaatagctatagcatgaacgtcgggtccgccgaggctccgaggggaacggggctggcgttgggttcatacattagtactagtagtagtacccatatactacgcagactctgtaggaaacgggccaattcaccatcctaccgaagaacgaactaaagtcgaacccaaaagtaacctactaaccttagttaccttacgtacgaaaccgtaaaattacggaaaacctacggtacccgtaagggaaaggaacgggaaacccgggaaagggaacccgaaacggggtccttaaggttaaacttaagtttaaaccggtggttacggaacgggtaagtaaaaggtttcgtttttaccgaaggtttaactacccggacggtaccggttaacggggtttcccccggaccccggttaacgggggg

SEQ ID NO: 365604 - DNA, 843 bp, Homo sapiens
  misc_feature: GZ8MTXP02FM425.45.63.F08.1.454.CMB.2.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctggttttccttgttgctattttagaaggtgtccagtgtgaggtgcagctggtggagtcgtggggaggcttggtacagccgtgggggtccctgagactctcctgtgcagcctcgtgtacttccccttcaatagctatagctatcgaacgtcgggtccgaccgacggtctccggaaggggacggggtcgtgggtcggttgggtttaccaagttactaacgtttagtaacgtaaggttaacgtaacgttaacccctaattaactaaccgtaacgacgaacgtaaccgttcgttaggtacgggtaaaaccgggggaccccgttaaactttacccgaaaccccgttactttacccccgtacccgaaaagggtaaccgaaaacctaaacggttacccgaaaccccgtaaaacggaaaaccctttacccgtaaccgtttacgttaacctttaccggttaaacgaaacctaaaaacgttaccgggaaaaaccgtccgggtaaaccgttaacgggaaagggaacgggaaaccgggaaacggggtaaaccgaaccggggttacgttaaagtttaaacgtttaaacgtttaaccggttggttaacgggtaacggttaaggttaacgtttaacgtttttacggtaagttaacccgtaccgtaccggtaccggtttaaccggggtttaccccggacccccggggtttaaccggggg

SEQ ID NO: 365605 - DNA, 708 bp, Homo sapiens
  misc_feature: GZ8MTXP02F4DDX.45.63.F08.1.454.CMB.2.raw
  modified_base (278)..(278): a, c, t, g, unknown or other
tcagacgcgatcgacacgaccggtgctcgatttagcgatcgtataagggggagagaggtgccttagccctggattccaaggcattttccacttggtgatcagcactgaacacagaggactcaccatggagttggggctgtgctgggttttccttgttgcttattttagaaggtgtccagtgtgaggtgcagctggtggagtcgtgggggaggtcttggtacaggccgtcggggggtccctgagtactatcctggtgcacgcctctggacttccccttnaatgctatagcatgaacgtcgggtccaccgaggcctcgaggggaacggggcgtagggcggttgggtttcaattactaagtttacgtactaaggtaagttacgtaacccctaattaatacgtacgacaacggtacttcgtagttagggaaacggggccgtaactttaccgaaacctctcccgtaacccaggaaacgaaacaaacgttacgaacccaaacgtaaacctcaacctagttactacgtacgaaactaaagtagaaaccacgtaccgagaaacgacgggaaccggaagggaaccgtacggtacgttaggtaacgttaacttaccggttaggtacgacgtaacggttagttacgtttttacggaacgtttctacccggtaacggtccggtttacgggttaccccggtaccccgggttaacccggggg

SEQ ID NO: 365606 - DNA, 530 bp, Homo sapiens
  misc_feature: GZ8MTXP01E3B7M.17.62.F07.1.454.CMB.2.raw
  modified_base (371)..(371): a, c, t, g, unknown or other
  modified_base (499)..(499): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagcctgcctgaccctttcgggtncgcagcctgaggatgagctgagtatactgcttgctctcctatagtgtgttcgggtgttcggggcggtagggaccaagctgaccgtcctaggtcagcccaaggctgccccttggtcacgtctgttcccnccttcctcctagtctacgcttgaacgcgggc

SEQ ID NO: 365607 - DNA, 530 bp, Homo sapiens
  misc_feature: GZ8MTXP01A8ZI8.17.62.F07.1.454.CMB.2.raw
  modified_base (369)..(369): a, c, t, g, unknown or other
  modified_base (440)..(440): a, c, t, g, unknown or other
  modified_base (487)..(487): a, c, t, g, unknown or other
  modified_base (500)..(500): a, c, t, g, unknown or other
  modified_base (524)..(524): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggtccaacagaagcctggccaagcccccaggacactgatttatgatacaaacaaacaaacactcctggacccctgccccgttctcaggctcctcgttggggcaaagcctgcctgtacccttcgggcncgcagccctgacggatggaggtctgtagtattactgtccttgctctctatagtgtgttcgggtgtcggggnggagggacagctgaccgtctaggtcagccaggctcgccccttggtcnctcgtcgttcccnccttcctcctcgtctacgcttcgngcgggc

SEQ ID NO: 365608 - DNA, 548 bp, Homo sapiens
  misc_feature: GZ8MTXP01DJF0O.17.62.F07.1.454.CMB.2.raw
  modified_base (285)..(285): a, c, t, g, unknown or other
  modified_base (409)..(409): a, c, t, g, unknown or other
  modified_base (503)..(503): a, c, t, g, unknown or other
  modified_base (517)..(517): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgattangatacaaacaaacaaacactcctcggacccctgccccgttctcaggcctccgtcgttcgggggcaaagcctcgcctgtacccttcgggtcgcgcacgcctagacggatgaggctgagtattacngcttgctctctatagtgtgttcgggtgttcgggggcgggtagggaccagcgtcgaccgtcgtaaggtcacgcccaaggctcgccccttggtccncgtctcgttccccnccttcctcctagtctacgcttagcgcggtcg

SEQ ID NO: 365609 - DNA, 535 bp, Homo sapiens
  misc_feature: GZ8MTXP01B4QCV.17.62.F07.1.454.CMB.2.raw
  modified_base (327)..(327): a, c, t, g, unknown or other
  modified_base (494)..(494): a, c, t, g, unknown or other
  modified_base (506)..(506): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgatacaaacaacaaacactcctgacccctgcccggttcncaggctccctcgttggggcaagcctgcctgaccctttcgggtgccgtcagccctggacggatcgagggctgagttattactgcttgctctcctatagtgtgttgggtgttcggggcggtagggaccagctgaccgtcctaggtcagcccaagctcgccccttggtcnctctcgttcccnccttcctcctgtctacgcttgcgcgggtc

SEQ ID NO: 365610 - DNA, 540 bp, Homo sapiens
  misc_feature: GZ8MTXP01DSU0W.17.62.F07.1.454.CMB.2.raw
  modified_base (497)..(497): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaaacaaacactcctcggacccctgcccggttctcaggctccctcgttgggggcaaagcctgcctgaccctttcgggtcgcgcagccctgaggatggaggctgagtattactgcttgctctcctatagtgtgttcgggtgttcgggggcggtaggggaccaagctgaccgtctaggtcagcccaaggctcgccccttggtccncgtctcgttccccgccttcctcctagtctcgcttgcgcggtcg

SEQ ID NO: 365611 - DNA, 559 bp, Homo sapiens
  misc_feature: GZ8MTXP01CSCCI.17.62.F07.1.454.CMB.2.raw
  modified_base (523)..(523): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggaccccctgccccggttctcaggctccctcgttcggggcaaagcctgcctgaccctttcgggtcgcgcacgcctgaggatgagctgagtatactgcttgcttctcctatagttgtggttcgggtgttacgggggcggtagggaccaagctgacccgtcgtacggtcacgcccaaggcctcggcccccttcgggtcccacgttcctcgttccccncccttcctccctagtcctacgcttcggcgcgggtcg

SEQ ID NO: 365612 - DNA, 538 bp, Homo sapiens
  misc_feature: GZ8MTXP01AYU3D.17.62.F07.1.454.CMB.2.raw
  modified_base (287)..(287): a, c, t, g, unknown or other
  modified_base (495)..(495): a, c, t, g, unknown or other
  modified_base (509)..(509): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctgaccccctgccccggttctcacggcctcccgtcgttgggggcaaagccctgcctgtacccctttcgggtgcgcacgcctgacggagtgaggctgagtattactgcttgctctcctatagtgtgttcgggtgttcggggcggaggccaagcgtgaccgtctaggcacgccagctcgccccttcggcncgtctcgttccccncccttcctcctagtcacgcttgcgcggcg

SEQ ID NO: 365613 - DNA, 560 bp, Homo sapiens
  misc_feature: GZ8MTXP01D831J.17.62.F07.1.454.CMB.2.raw
  modified_base (530)..(530): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaaacaaacactcctcggaccccctgccccggttctcaggcctccctcgttcgggggcaaagccctcgccctgaccccgtttcgggtcgcgcagcctgacggatggaggctgagttattactgtcttgcttctcctagtaggttggtggttcggggtgttcgggggcgggagggtaccagctgaccgtcgtaggtcacgccaggctcgccccgttcggtcacctctcgttccccncccttctcctagtctcgcttgcgcgggtcg

SEQ ID NO: 365614 - DNA, 547 bp, Homo sapiens
  misc_feature: GZ8MTXP01D2973.17.62.F07.1.454.CMB.2.raw
  modified_base (283)..(283): a, c, t, g, unknown or other
  modified_base (379)..(379): a, c, t, g, unknown or other
  modified_base (487)..(487): a, c, t, g, unknown or other
  modified_base (498)..(498): a, c, t, g, unknown or other
  modified_base (538)..(538): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatgtccaacagaagctggccaagcccccaggacactgatttangataacaaacaaacaaacactcctcggacccctgcccggttctcgggctcctcgttgggggcaaagctcgcccctgacccgtttcgggtcgccgcnggccctggaggatggaggctgagtattactgcttgcttctctatagtggtgttgggtgtcgggcggggagggacaagcgtgaccgtcctaggtcacgtcccaaggccncgcccctggcncttcgtcgtccccgccttccttcctaagtctaacgctggngcggctggg

SEQ ID NO: 365615 - DNA, 538 bp, Homo sapiens
  misc_feature: GZ8MTXP01DLH1M.17.62.F07.1.454.CMB.2.raw
  modified_base (465)..(465): a, c, t, g, unknown or other
  modified_base (476)..(476): a, c, t, g, unknown or other
  modified_base (496)..(496): a, c, t, g, unknown or other
  modified_base (508)..(508): a, c, t, g, unknown or other
  modified_base (524)..(524): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaaagccccccaggacactgatttatgatacaaacaaacaaacactcctcggacccctgccccggttctcaggcctcccgtcgttcgggggcaaacgcctcgcctgaccctttcgggcgcgcagccctggaggatggagggctgagtattctgcttgctctcctagtgtggtgttcgggtgttcgggggcggaggaccagcngccgtcagtcngccagctcgccccttggtcnctctcgttcccncccttcctcctagtcncgcttgcgcggtcg

SEQ ID NO: 365616 - DNA, 549 bp, Homo sapiens
  misc_feature: GZ8MTXP01DL4ON.17.62.F07.1.454.CMB.2.raw
  modified_base (310)..(310): a, c, t, g, unknown or other
  modified_base (503)..(503): a, c, t, g, unknown or other
  modified_base (524)..(524): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaaacaaacactccnggacccctgccccggttcccagggcctcccgtcggttcgggggcaaagctcgccctgacccgtttcgggtgccgcaagccctggacgggatggaggctgacgtattactgcttgctcgtctatagtggtgttcgggtgttcggcggggagggccaagcgtgaccgtctaggtcagccaagctcgcccctggcncttctcgttcccgcccttccnctcgtctcgctgacgtcggctcggg

SEQ ID NO: 365617 - DNA, 539 bp, Homo sapiens
  misc_feature: GZ8MTXP01CDN2V.17.62.F07.1.454.CMB.2.raw
  modified_base (509)..(509): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgatacaaacaacaaacactcctggacccctgcccggtctcaggctcctcgttggggcaaagcctgcctgtacccttcgggtcgcgcagccctgaggatgaggctgagtattactgcttgctctctatagtggtgttcgggtgttcgggggacggaggggccaagcgtgaccgtcgtaggtcacgcccagggctcgccccttaggtcactccgtcttaccccnccttcctctacgtctcgcttgcgcgggtcg

SEQ ID NO: 365618 - DNA, 547 bp, Homo sapiens
  misc_feature: GZ8MTXP01B715A.17.62.F07.1.454.CMB.2.raw
  modified_base (513)..(513): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctcggacccctgccccggttctcaggcctccctcgttgggggcaaagcctgcctgaccctttgggcgcgcagcctggaggatgaggctgagtattactgcttgctctctagtagtcggtgttcgggtgttcgggggcgggagggtaccaagctcgaccgtcgtaggtcagcccaaggctcgccccttggtccactctcgttccccncccttcctccagtctacgcgttcgaacgcggtcg

SEQ ID NO: 365619 - DNA, 529 bp, Homo sapiens
  misc_feature: GZ8MTXP01CFNNV.17.62.F07.1.454.CMB.2.raw
  modified_base (310)..(310): a, c, t, g, unknown or other
  modified_base (407)..(407): a, c, t, g, unknown or other
  modified_base (485)..(485): a, c, t, g, unknown or other
  modified_base (498)..(498): a, c, t, g, unknown or other
  modified_base (514)..(515): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgaatacaaacaaacaaacactccncgacccctgcccggtctcagctcctgtggggcaaagcctgcctgtaccccgttcgggtcgcgtcgacgccgtggaggactggacgctgagtattacngtcttgctctctatagtgtgtcgggtgtcgggggcggaggacgagctgccgtctaggtcagccagctcgcccttgtcncgtctcgttcccnccttcctcctagtccnnccgttgcgcggtcg

SEQ ID NO: 365620 - DNA, 555 bp, Homo sapiens
  misc_feature: GZ8MTXP01DQOAH.17.62.F07.1.454.CMB.2.raw
  modified_base (286)..(286): a, c, t, g, unknown or other
  modified_base (382)..(382): a, c, t, g, unknown or other
  modified_base (417)..(417): a, c, t, g, unknown or other
  modified_base (527)..(527): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttangatacaaacaaacaaacactcctcggacccctgccccggttctcaggcctcccgtcgttgggggcaaacgccctcgcctgtacccctttcgggtcnccgcagcccgtgacggatggaggctgagtattacngtcttgcttctcctatgtggtgttcgggtgttcgggggcggagggtaccaggctgaccgttcgtaggtcacgtcccaggcctcgccccttggtccacgtctcgttccccnccttcctctagtcacgcttgcgcggtcg

SEQ ID NO: 365621 - DNA, 603 bp, Homo sapiens
  misc_feature: GZ8MTXP01DD6KT.17.62.F07.1.454.CMB.2.raw
  modified_base (567)..(567): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctatggttaccaacagaagcctggccaagcccccaggacactgattatgataacaaacaaacaaacactcctacggacccctgccccggttctccgaggcctcctcggttgggggacaaacggcccctacgcctcggtaccccgtttcggggctccgcacgcccgtaggacggagtcggagggctagtagtattactgcttgcttctcttagtgttggtggttcgggttggttcgggggacgggtaggaccaaggcgtcggaccgtccgtacggtcacgcccgaacgtccgtccgccccgttggtccttaccgttcctccgttccccncccttccctccacgtcctacgcgttggcgttcggcg

SEQ ID NO: 365622 - DNA, 620 bp, Homo sapiens
  misc_feature: GZ8MTXP01B48LZ.17.62.F07.1.454.CMB.2.raw
  modified_base (288)..(288): a, c, t, g, unknown or other
  modified_base (569)..(569): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangataacaaacaacaaacactcctcgacccctgccccggttctcgacggcctcccgtcggttcgggggacaaacgccctacgcctcggtaccccgtttcggggtcgccgcgacgccgtgacggtagtggaggtctgtagttattacgtgtcttgccttctcctagttaggttggtggttcgggtggttcggggggcggtagggaccaggcgtcgaccgtcgtaggtccacggcccgaaggtcctccgccccgttcggtccttaccgttcctccgttcccccncccttcccttccctaccgttccgtacggtcgttcggaaccgggcgggtccg

SEQ ID NO: 365623 - DNA, 530 bp, Homo sapiens
  misc_feature: GZ8MTXP01DLE8L.17.62.F07.1.454.CMB.2.raw
  modified_base (250)..(250): a, c, t, g, unknown or other
  modified_base (284)..(284): a, c, t, g, unknown or other
  modified_base (483)..(483): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggtccaanagaagcctggccaagcccccaggacactgattangatacaaacaaacaaacactcctcggacccctgccccggttctcaggcctccctcgttgggggcaaacgcctcgcctgaccctttcgggtcgcgcagcctgagatgagctgagtatactgcttgctctcctatagtgtgttcgggtgttcggggcggtaggaccaagctgccgtcagtcagccaagctcgccccttgcnccgtctcgttccccgcccttccgtcctcgtctacgcttgcgcggtcg

SEQ ID NO: 365624 - DNA, 599 bp, Homo sapiens
  misc_feature: GZ8MTXP01D48SV.17.62.F07.1.454.CMB.2.raw
  modified_base (275)..(275): a, c, t, g, unknown or other
  modified_base (297)..(297): a, c, t, g, unknown or other
  modified_base (313)..(313): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatgtcattatccctatgtcaacagagctgcaagccccagacactgattangatacaaacaacaaacactccncgacccctgtcccgtncaggctcctggttcggggcaacgcctcgccgtcgtacccgtttcgggcgccgtcgacgcccgtgaggagtcggaggtctagagttattacgtgtcttgccttctcctagtagtgggtgttcggggttcggtcgggggacgggtagggaccgaaggtccgtcgtaccgtaccgtaggtccagacccgtaaggccctccggtccccgttcggtcccttacgtttcccggttccccttccccttcccgttccgttaacgtccgtaacgtcgtggcggtcgggcgtcggg

SEQ ID NO: 365625 - DNA, 538 bp, Homo sapiens
  misc_feature: GZ8MTXP01A516A.17.62.F07.1.454.CMB.2.raw
  modified_base (469)..(469): a, c, t, g, unknown or other
  modified_base (479)..(479): a, c, t, g, unknown or other
  modified_base (492)..(492): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgccccggttctcaggctccctcgttggggcaaagcctgcctgacccttcgggtgcgcagcctgaggatgaggctgagtattactgcttgctctcctatagttggtgttcgggtgttcggggcggtagggaccaagctgaccgtcgtaggtcngcccaaggcncgccccttggtcncgtctcgttccccgcccttcctcctagtctacgccttgcgcgggcg

SEQ ID NO: 365626 - DNA, 664 bp, Homo sapiens
  misc_feature: GZ8MTXP01ECEPY.17.62.F07.1.454.CMB.2.raw
  modified_base (321)..(321): a, c, t, g, unknown or other
  modified_base (377)..(377): a, c, t, g, unknown or other
  modified_base (431)..(431): a, c, t, g, unknown or other
  modified_base (436)..(436): a, c, t, g, unknown or other
  modified_base (445)..(445): a, c, t, g, unknown or other
  modified_base (451)..(451): a, c, t, g, unknown or other
  modified_base (465)..(465): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggacgccctcactgactgtcgtcccgagggaggacagtcactctcacctgtcggctccagcacgtggacgctgtaccaacctaagtggtactaattactcccctacgttcggtaccaaacgaacgaacgccgtcggacccaaaccgcccccgaaggacactgtaatttanagaactaaacaaaacaaacaaactcctaccgtaccggacccctcggtcccggttcncgacggtccgtccgtggtacggggacaacgccctcgcctcgtacccgttcggcncgcgngccgtgagngtaggngtctagtatactgngtcttgtcttctacgtagtggttgggttcggttcgggtcgggttacgggggacgggtaacggaacctaggccgtacgtacccggtcgtacgtaccgacggaccgtacgtcccgtaaccgtccccgttgtcccttccgttccgtccccgttcccgttcccttcctccgtacgtccgtacggcgttacggcggttcgggcg

SEQ ID NO: 365627 - DNA, 604 bp, Homo sapiens
  misc_feature: GZ8MTXP01B1YPM.17.62.F07.1.454.CMB.2.raw
  modified_base (289)..(289): a, c, t, g, unknown or other
  modified_base (373)..(373): a, c, t, g, unknown or other
  modified_base (543)..(543): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtctattatccctactggttaccaacagaacgcctggccaagcccccaggacactgattangataacaaacaacaaacactctcggacccctgcccgttctcacgtcctcctcggtggggacaagcctcgcctgacccttgggcncgcagccgtggagagtggaggtctagtagtattactgtcttcgcttctcttacgtagttgggtggttcggggttcggtttcggggggacgggtacggggtaaccgacggtcgtacgtacccgtccgtacggtcgacgtcccgaacggccgtccgtccccgttcggtaccnccgttccttccgttccccttccccttccgtccctacgtccgtacgcttacggcgcggtcgg

SEQ ID NO: 365628 - DNA, 550 bp, Homo sapiens
  misc_feature: GZ8MTXP01BR867.17.62.F07.1.454.CMB.2.raw
  modified_base (287)..(287): a, c, t, g, unknown or other
  modified_base (395)..(395): a, c, t, g, unknown or other
  modified_base (502)..(502): a, c, t, g, unknown or other
  modified_base (507)..(507): a, c, t, g, unknown or other
  modified_base (532)..(532): a, c, t, g, unknown or other
  modified_base (542)..(542): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaaacaaacactcctcggacccctgccccggttctcaggctccctcgttgggggcaaagccctcgcctgacccctttcgggtcgccgcagccctgacggntggaggctgagtattactgtcttgcttctcctagtagtgggtgttcgggtgttcgggggcggaggggaccaagctgaccgtcgtaggtcagcccaaggctcgccccnggtcncgtctcgttccccgccttcctcctntctcgcttgngcgggtcg

SEQ ID NO: 365629 - DNA, 649 bp, Homo sapiens
  misc_feature: GZ8MTXP01A0ZJH.17.62.F07.1.454.CMB.2.raw
  modified_base (250)..(250): a, c, t, g, unknown or other
  modified_base (279)..(279): a, c, t, g, unknown or other
tcagcgtagactagcacgaccggtgctcgatttagtagtcgcatagagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcctatggttccaanagagctgccagccccaggacactgattangataacaaacaacaaacactcctcggacccctgccccgttctcgacggtcctccgtcggttcgggggacaaacggctacgccctcgtacccgtttcggggtcgccgcacggcctagggacggagtacggacgggtctaggtagttacgttacgtgtctttcgccttctaccctagttacgttcgggttggtttcggggttcggggtttcggggacgggtaacggggacccgtaaggtccgtcggtaccgtaccggttacggtccgaccggacccgaacgggtcctacccggccccgtcggttacctccgttccttccgttccccgttccctcccgtcctaacggtcctaccgcgttcggaacggtccggg

SEQ ID NO: 365630 - DNA, 639 bp, Homo sapiens
  misc_feature: GZ8MTXP01ACVZG.17.62.F07.1.454.CMB.2.raw
  modified_base (289)..(289): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgccccccaggacactgatttangataacaaacaaacaaacactcctcggacccctgcccggttctcacggtcctcccgtcggttgggggacaaacggccctcggcctcggtaccccgtttcggggtcgccgcgacggccctggaggagtcggaggtcgtgtaacgttattcgtcgtcttcgtcttccttcctaagttggttgggttcggtttcggggttggttcggggggacggggtagggtacccgaaaggtccgtacggaccgttccggtaggtccgacggcccgaagggtccctccggccccgttcggtccaccgttccgtccgttccccgttcccttccctcttacgtctacgcgttgcggcgggtcg

SEQ ID NO: 365631 - DNA, 704 bp, Homo sapiens
  misc_feature: GZ8MTXP01ARAHS.17.62.F07.1.454.CMB.2.raw
  modified_base (292)..(292): a, c, t, g, unknown or other
  modified_base (334)..(334): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactccctatcggttaccaacagaacgcctggaccaacgcccccaggacactgattangataacaaacaaacaaacactcctacgacccctgcccgttcncgacggtccttcccgtcggttcgggggacaaacgccctacgtccgtcgtaccccgtttcgggtcgccggcgacggtcccgtagggacggtagtcggagggtctaggtaagttaacgttaaccgttgtccgtttcggtccttaccttaccgttaacggttagggttggggttcgggtttcgggggttcgggttacgggggacggggtaacggggtaccaaggtccgtacggtaccggtcgtacggtcgtaccggacccaacgggtccctaaccggtcccccgttagggtcccttcgttcccgtccggtttcccccgccccgttccgtaacccgttacgtcgttacccgtcgttacggcgggttcggtccgg

SEQ ID NO: 365632 - DNA, 716 bp, Homo sapiens
  misc_feature: GZ8MTXP01E05S4.17.62.F07.1.454.CMB.2.raw
  modified_base (289)..(289): a, c, t, g, unknown or other
  modified_base (416)..(416): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctatggttaccaacagaagcctggccaacgcccccaggacactgatttangatacaaacaacaaacacctcctcggacccctgtccccggttctccaacgggtcctcccgttcggttgggggaccaaacggccctcggcctcgtacccgtttcgggaacgccgtcacgccgtgaggntgggagctgaacgttattacgtgtcttgcctcttacctagttcggtgggttcggttcggggttgttcggggggcgggtaacggggacctaaacggcgttaccggacccggttccgtaaacggggttcctaaccgggaccccgtaaacgggtccccgtcccggtcccccccgtttcggggtaccccttaaccgtttccccgttaacccggtttcccccccgttaccccgtttcccccttaacccgttaccggttcccgtttaacccggccgttaacgggccggggttccggggttcccggg

SEQ ID NO: 365633 - DNA, 606 bp, Homo sapiens
  misc_feature: GZ8MTXP01DCHKO.17.62.F07.1.454.CMB.2.raw
  modified_base (289)..(289): a, c, t, g, unknown or other
  modified_base (314)..(314): a, c, t, g, unknown or other
  modified_base (541)..(541): a, c, t, g, unknown or other
tcagcgtagactagcacgaccggtgctcgatttagtagtcgcataaagggaagggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttaccaacagaagcctggccaacgcccccaggacactgatttangataacaaaacaaacaaacactccncggaccccctgaccccggttctcacggcctcccgtcggttgggggcaaagccctcgccctgtacccgtttcgggcgtcgcacgcctgggaggtagtggaggtcgtagagttattacgtgtcttgcttctctagtagtggtgttcgggtgttcgggggcgggtacggggaacacggcgtcgaccgttccgtaggtccacgcccgacgccgtccgccccttggtacccncgttccgtccggttccccgttcccttaccttcccgtagttccctcgcgttcggtaacgcgggccg

SEQ ID NO: 365634 - DNA, 675 bp, Homo sapiens
  misc_feature: GZ8MTXP01BHSEG.17.62.F07.1.454.CMB.2.raw
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttatgaataacaaacaacaaacactcctcggacccctgccccggttctccgaggcctcccgtcggttgggggacaaacgcctcgcctcgtaccccgtttcgggtcgccgcgagccctggacggatggagggtctaggaagttattacgtggtcttggccttcttccgtaagttggttgggttggtttccggggttggtttcggggggcggggtaacggggacccgaaggccgttacggaccgttccgtaaggggtccaacggaccccgaacgggtcctccggccccccgttgggtcccttccgttccgttcccggttcccccaccccgttccccttccccgttacgggttccctaacccggtccgttacggtccgggttccggggtcccgg

SEQ ID NO: 365635 - DNA, 678 bp, Homo sapiens
  misc_feature: GZ8MTXP01BFLU1.17.62.F07.1.454.CMB.2.raw
  modified_base (336)..(336): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtacattactccctactggttaccaacagaagcctggccaacgcccccaggacactgtattatgaataacaaaacaaacaaacactcctcggacccctgcccgttcncaggtcctcctcggtggggacaagccctcgcctgtacccgtttcgggcgcgcgacgccgtaggaggtatcgggaggtctggagttacgttacgtggtcttgcctttctaccttaagtggttgggttggtttacgggggtcggtttcggggggcggggtaacggggtaaccgaaacgtccgtacggtacccgttccgtaaacgggtcctaacgggacccgtaacgggtccgtccggtcccccgttcggggtcccttccgttcccggttcccgtttaccccccgttccccttcccttaacccgttacgtccgtaccgtcgttcgggtccggttccgggggtccg

SEQ ID NO: 365636 - DNA, 655 bp, Homo sapiens
  misc_feature: GZ8MTXP01CWI6R.17.62.F07.1.454.CMB.2.raw
  modified_base (296)..(296): a, c, t, g, unknown or other
  modified_base (340)..(340): a, c, t, g, unknown or other
  modified_base (342)..(342): a, c, t, g, unknown or other
  modified_base (362)..(362): a, c, t, g, unknown or other
  modified_base (368)..(368): a, c, t, g, unknown or other
  modified_base (398)..(398): a, c, t, g, unknown or other
  modified_base (408)..(408): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcacgtggagctgtccaactagtggtactattactccctatcggttaccaacagaagcctggcccaacgccccagacactgtatttanagaataacaaaacaaacaaacacctcgtacgacccctgcccgtncncgtcctccgtcgtggacacnccgtcncctgtcccgttggcacgcgacgctggacgngtggacggtntagtattacttacgtgtcttgtcttcttacgttaggttggttcggggttggtttcggggttcgggtccggggggtaacgggaccggggtaactacggtcgtccggtaacccgtcgtaacggtcccaaccggcccgtaaccggtcctaaccccgggtccccttcggtacccttccgttccccgttccttacccccgttccttacccgtaacttccgtaacttcggcttaccggcggttcggtaaccgg

SEQ ID NO: 365637 - DNA, 673 bp, Homo sapiens
  misc_feature: GZ8MTXP01CAM5P.17.62.F07.1.454.CMB.2.raw
  modified_base (296)..(296): a, c, t, g, unknown or other
  modified_base (402)..(402): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtcccgaggagggacagtcactctcacctgtggctccagcactggagctgtcaaccaagtggtacattactccctatcggttaccaacagaacgcctggacccaacgcccccaggacactgattangataacaaacaaacaaacacctcctcgacccctcgccccggttcgtccgggtcctccgtcggttgggggacaaacgctccgccctgtacccgtttcgggcgccgcncggccgtaggaggagtggaggctagagttattagtcgtcttgcttcttccgttaagtggtgggttcggtttcggggtggtttccggggacgggggtaacggggaccgtaacggtccgttacggtacccgttcccgtagggtaccgacgtaccccgaacgggttcccgtccccgtcccccgttacggttcctacccgttccgttcccgttcccccgttaccccgttccttcccgttaagtcctaacgtcgtcggcggtcgggttcgtccggg

SEQ ID NO: 365638 - DNA, 668 bp, Homo sapiens
  misc_feature: GZ8MTXP01CP2AK.17.62.F07.1.454.CMB.2.raw
  modified_base (294)..(294): a, c, t, g, unknown or other
  modified_base (320)..(320): a, c, t, g, unknown or other
  modified_base (339)..(339): a, c, t, g, unknown or other
  modified_base (393)..(393): a, c, t, g, unknown or other
  modified_base (426)..(426): a, c, t, g, unknown or other
  modified_base (608)..(608): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccagggagggacagtcactctcacctgtggctccagcactggagctgtcaccaatggtcattctccctactggttaccaacagaacgcctcggaccaacgcccccaggacactgatttanagataacaaacaacaaacacctaccncggacccctggcccgttcncacggcctcccgtggttacggggacaacgccctacgcctgtacccgtttcgggngccgcagccgtggaggtgcgaggctagtagttnttacgtgtcttacgcttcctaccgttagttcggttgggttcggttcgggggtggtttccggggggcggggtaacgggtaccgaaggtccgtcggtacccgtcgtacgggtcaccggacccgaacggtcccgtaacccggtcccccgttacggtcccaccgttcccgttcccgttaccccccncccgtttaccctcccgttacgtcccgttaccggtcgttcggaaccgggttccgggtccgg

SEQ ID NO: 365639 - DNA, 599 bp, Homo sapiens
  misc_feature: GZ8MTXP01B6CHN.17.62.F07.1.454.CMB.2.raw
  modified_base (247)..(247): a, c, t, g, unknown or other
  modified_base (280)..(280): a, c, t, g, unknown or other
  modified_base (282)..(282): a, c, t, g, unknown or other
  modified_base (284)..(284): a, c, t, g, unknown or other
  modified_base (298)..(298): a, c, t, g, unknown or other
  modified_base (302)..(302): a, c, t, g, unknown or other
  modified_base (355)..(355): a, c, t, g, unknown or other
  modified_base (369)..(369): a, c, t, g, unknown or other
  modified_base (379)..(379): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatgtcattactcctatgttcaanagagcctgaccaacgccccaggacactgattanananaacaaacaacaacnctcncgacctcgccgtcgcgctcgtggtggacacgctccgcctcgtccgtcggcgcncgcgcgagagacgngcgtgtagtnttacgttcgtctctctacttacgtagttgttacggttgggttcgggttcgggttcgggtacgggacgggggaacgtaacggtacgtacgtacggtaccgtacgacggtaccgacgtaccggacgtcccgtcccgtcccgtcgttccgtccgttcccgttcccgtaccccgttcccgttccgttccgtaaccgtcgtcgtcggcggcggtccggcgtaacg

SEQ ID NO: 365640 - DNA, 703 bp, Homo sapiens
  misc_feature: GZ8MTXP01CUMFD.17.62.F07.1.454.CMB.2.raw
  modified_base (216)..(216): a, c, t, g, unknown or other
  modified_base (245)..(245): a, c, t, g, unknown or other
  modified_base (250)..(250): a, c, t, g, unknown or other
  modified_base (281)..(281): a, c, t, g, unknown or other
  modified_base (384)..(384): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctccagcactgganctgtcacatgtcattctcctatgtccaanagaancctggccaacgccccaggacactgtatttangaactaacaaacaaacaaacactccgacgacccctgtacccggttctacgacggtccctcccgtgggtcggggacaagccctcgcctgtaccccgttcgggcncgcgagcctaggagtacgtgacggtcttagtaacgttacgttactggtcctttcggtcttaccgttacgttaaggttgggttcgggttcgggtttcggggttacgggtttccggggggacggggtaacggggtaacctaacgggtccgttaccggacccggtttacgtaaccgggtcgtacccggacccggaaacgggtcccgtccccggtaccccgttcgggtaccttcccgttacccttcccggttacccccgttaccccttccccgttaaccgttccgtccgtccggttcgcgggtaaccgggttccggggtcccg

SEQ ID NO: 365641 - DNA, 660 bp, Homo sapiens
  misc_feature: GZ8MTXP01C96FB.17.62.F07.1.454.CMB.2.raw
  modified_base (218)..(218): a, c, t, g, unknown or other
  modified_base (291)..(291): a, c, t, g, unknown or other
  modified_base (396)..(396): a, c, t, g, unknown or other
  modified_base (402)..(402): a, c, t, g, unknown or other
  modified_base (444)..(444): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtcggctccagcactgganctgtcaccaatggtcattactccctatggttaccaacgagacgcctggccaacgccccaggacactgtattangaataacaaacaaacaaacacctcctacggacccctgtccccgttctccgacggtcctcccgtcggttggggaccaacgtccctcgccgtcgtcccgttcgggcnccgcgngccgtgaggtatggagtctagtacgttattacgtgtcgttcnccgttcttcctaggttaggttgggttcgggttcggggttgttccggggggacggtaacggggtaaccagggtctccggtaacccgttcgtaacggtcctaccgcccgtacggtccctcccgtccccgttacggtcccttacgtcccgttcccgttccccgttcccttcccgtttaaccgtacgttccgttacgccgttacggccggcgggtaaccg

SEQ ID NO: 365642 - DNA, 814 bp, Homo sapiens
  misc_feature: GZ8MTXP01A29CG.17.62.F07.1.454.CMB.2.raw
  modified_base (325)..(325): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggacgccctcactgactgtcgtccccaggagggacagtcactctcacctgtcgctccagcacgtggatctgtacaacaagtggtactattactcccttacgttcggttaccaaacgtacggaacgtcccgtcggacccaaaccggccccccgaagggaccacttagtaatttanagtaaacaacaaaacaaaccaaacgtacctccgtaccggaccccgtacgtccccgttcaccgtacggtccttaccgttcgggtacggggaacaaacggtccccttccggccgttaccggtcccggtttcgggacgccgccgacggtcccgtagaacggtgtcgggacggttcgtagtagttacttacgtcggttcgttcgtaccttcgttaccgttaaggttacgggttcggggtttgggtttaccggggtttcgggtacccggggggttaaggggaaccgggtaaaccgtaacgggtccgttaccggtacccggttacggttaaccgggtccgtaaacccgggtcccgtaacgggttccccgcccgggttccccccgttgggtaccccttaccggttccctttccccggttacccccgttccccgttcccttaacccgttaccgtccggtaaccgtcccggttagggccgggttcccgggtaaccggg

SEQ ID NO: 365643 - DNA, 681 bp, Homo sapiens
  misc_feature: GZ8MTXP01B2EXQ.17.62.F07.1.454.CMB.2.raw
  modified_base (254)..(254): a, c, t, g, unknown or other
  modified_base (330)..(330): a, c, t, g, unknown or other
  modified_base (632)..(632): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtcggctccagcactggagctgtcaccaatgtactattactcctatgtaccaanagagctggcaacgccccagacactgattatgataacaaacaaacaaacactccgtacgacccctcgtcccggttcnccgtaggcctaccgtcggttcgggggacaaacgtccctacgcctggtaccccgtttcggggacgccgtccgaggtcccgtaggagggacgttacggggtaacggccgttaggtaacgttaacgtttaacgcggttcttcggtctttacctccgttagttaggttgggttcgggtttggggttacggttacggggggcgggtaacggggtaccaacgtcggtcgtacccggtcgtacgggtccacggacccgtaagggtcctaaccgtccccgttcggtccttaccgttctcccgttaccccncccttccctaactccggttaaccttacggcgttacggtcggccggtcgg

SEQ ID NO: 365644 - DNA, 798 bp, Homo sapiens
  misc_feature: GZ8MTXP01DSMB9.17.62.F07.1.454.CMB.2.raw
  modified_base (305)..(305): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtcggctccagcactggagctgtacaacctaatggtactattactcccttactcggttaccaacagaacgcctggacccaacgcccccaggacactgtaactttanagaataacaaaacaaaccaaactacctacccgtacgggacccccttacggtccccgttacgtaccgacggtcccttcccggttacgggttacgggggactaaacggtcccctcggtccccgtacggttacccggtttcggggaacgccgccgtaacgcccgtagggacggacgtgggaacgggtctagtaagttaacttcggtgtcttcgtacttacttacgttagttacggttgggttacgggttcggggttacgggtaccggggggaacggggtacgggaaccgtaacggtaccggttaccggacccgttaccggtaaccgggtaccgtaacccggtaccccggtaaccggtccccggtccccggttccccgttacggtaccccttacccggtacccggtttaccccttacccccgttcccgttccccgttaaccgtaccggttaacccgaccggtccggttacgggtaacccggggttccgggtaaccgg

SEQ ID NO: 365645 - DNA, 693 bp, Homo sapiens
  misc_feature: GZ8MTXP01AX1EP.17.62.F07.1.454.CMB.2.raw
  modified_base (255)..(255): a, c, t, g, unknown or other
  modified_base (289)..(289): a, c, t, g, unknown or other
  modified_base (291)..(291): a, c, t, g, unknown or other
  modified_base (300)..(300): a, c, t, g, unknown or other
  modified_base (307)..(307): a, c, t, g, unknown or other
  modified_base (328)..(328): a, c, t, g, unknown or other
  modified_base (393)..(393): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtgctccagcactggagctgtacaccaatggtctattctccctattcggtaccaanagacgcctgaccaacgccccaggacactgattananataacaaanaacaacnctcctcggacccctgcccgtntccgacgtcctaccgttcgggtacggggacaacgtcccgtcgtcctcggtaccccgtttggggcnccgctacggccgttaggacggtagttcgggaaggtcgtagtacgttaacgttcgtgtacctttgtcccttcgtaccgttaagttcgggttggggttcgggtttccggggttggttaccggggggacggggtaacggggtaaccgacggtccgttacgggtacccgtacggttaccggccgtaaccgacccggtacgtcccgaacccgtcccgttcggttccttacccggttttcctacccccacccgttccttccgttaacgttccgaacgtccgtggacccggtcgggttaaccgtggg

SEQ ID NO: 365646 - DNA, 655 bp, Homo sapiens
  misc_feature: GZ8MTXP01B8B20.17.62.F07.1.454.CMB.2.raw
  modified_base (291)..(291): a, c, t, g, unknown or other
  modified_base (331)..(331): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtctattactccctactggttccaacagaacgcctggaccaacgccccaggacactgattangataacaaacaaacaacactcctcgaccctcgcccgttcncgcgtctcccgtcggtaggggcaacgtccgtccgccgttcgtacccgtttcggggtcgccgtcgacgccgtggacggacgtgggaggtctggtagttacgttacgtcgtcttcgtcgttctaccttagttcggtgggttcgggtttcgggttcgggttcgggggacggggtacgggacctacggcggttccggtaccgttccggtacggtccgaccgccgaacggtccctccgtccccgttcggtccgttccgttccgttcccgttaccccgttcccttacccgttccgtacgtccgtcggtcgttcggaaccgggcgggtcgg

SEQ ID NO: 365647 - DNA, 533 bp, Homo sapiens
  misc_feature: GZ8MTXP02F7ANK.17.62.F07.1.454.CMB.2.raw
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgtggggcaaagcctgccctgaccctttggtcgcgcagcctgagatgagctgagtattactgcttgctctctatagtggtgttcgggtgttcgggcggtagggaccaaggcgtcgaccgtccgtaggtcacgcccaaggctcgccccctggtcactctcgttcccacctcctcctacgtctacgctcgacgtcgggc

SEQ ID NO: 365648 - DNA, 564 bp, Homo sapiens
  misc_feature: GZ8MTXP02JG27R.17.62.F07.1.454.CMB.2.raw
  modified_base (308)..(308): a, c, t, g, unknown or other
  modified_base (374)..(374): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgattatgatacaaacaacaaacactccnggacccctgcccggtctcgggctccctcgttggggcaaagctcgccctgaccctttcgggtgcgcngcctgacggatgaggctggagtattactgcttgctctcctatagtggtgttcggggtgttcggcgggtagggaccgaaggcgtaggacccgtccgtaagggtccaggcccaagggcctcgcccccgtcggtcccactcctcgtttccccgaccccttcctcctaagtcctacgctgacggcgggctcggg

SEQ ID NO: 365649 - DNA, 539 bp, Homo sapiens
  misc_feature: GZ8MTXP02I3BIO.17.62.F07.1.454.CMB.2.raw
  modified_base (285)..(285): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattangatacaaacaacaaacactcctggacccctgccccggttctcaggctccctcgttggggcaaagcctgccctgacccctttgggcgcgcagcctgagatgaggctgagtattactgtcttgctctcctatagtggtgttcgggtgttcgggcgggaggaccaagctgaccgtctacggtcacgcccgaaggctcgccccgtcggtccactctccgttccccaccctcctcctacgtctacgctcgacgcggtcg

SEQ ID NO: 365650 - DNA, 540 bp, Homo sapiens
  misc_feature: GZ8MTXP02IZ3VY.17.62.F07.1.454.CMB.2.raw
  modified_base (288)..(288): a, c, t, g, unknown or other
  modified_base (390)..(390): a, c, t, g, unknown or other
  modified_base (405)..(405): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaaggctggccaagccccccaggacactgatttangatacaaacaacaaacactcctggacccctgcccggttctcaggctccctcgttggggcaaagcctgccctgacccctttcgggtcgcgcagccctgacggntgagctgagtatacngcttgctctctatagtgtgttcgggtgttcggcggtaggaccaaggctgaccgtcgtaggtcagacccaaggctcgccccctggtccactcctcgttccccaccctcctccgtacgtctaccgctcgcgcggtcg

SEQ ID NO: 365651 - DNA, 536 bp, Homo sapiens
  misc_feature: GZ8MTXP02GI46L.17.62.F07.1.454.CMB.2.raw
  modified_base (288)..(288): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangataacaaacaacaaacactcctggacccctgcccggttctcacggctccctcgtggggcaaagccctgccctgtacccttgggtcgcgcagcctgacgatgagctgagtatactgtcttgctctctagtagtgtgttcgggtgttcggcggtagggaccaagctcgaccgtcgtaggtcacgccaaggctcgccccgtcgtcactctcgtccccgccctcctcctacgtctacgcgtcgcgcggtcg

SEQ ID NO: 365652 - DNA, 558 bp, Homo sapiens
  misc_feature: GZ8MTXP02G2Y9U.17.62.F07.1.454.CMB.2.raw
  modified_base (286)..(286): a, c, t, g, unknown or other
  modified_base (394)..(394): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattangataacaaacaacaaacactacctcggacccctcgccccggttctccgggcctcccgtcggttcggggacaaacgctccgcccctcgtaccccgtttcgggtgccgcngcctgacggatgaggctgagtatactgcttgctctcctatagtggtgttcgggtgttcgggcggaggacaagcgtgaccgtctaggtcacgcccaaggctcgcccctcggtcactcgtcgttccccgccctcctcctaacgtcctacgctgacggtcggctcgg

SEQ ID NO: 365653 - DNA, 529 bp, Homo sapiens
  misc_feature: GZ8MTXP02IQLQU.17.62.F07.1.454.CMB.2.raw
  modified_base (286)..(286): a, c, t, g, unknown or other
  modified_base (372)..(372): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctggacccctgcccgtctcgggctcctcgttggggcaaagctcgccctgaccctttcgggtgcgcngcctgagatgagctgagtatactgcttgctctctatagtggtgttcgggtgttcggcggagggtaccaagcgtacgaccgtcctaggtcacgccaaggctcgcccctggtcactctcgttccccgcctcctcctaagtctacgctgcgtcggctcgg

SEQ ID NO: 365654 - DNA, 552 bp, Homo sapiens
  misc_feature: GZ8MTXP02HSJ02.17.62.F07.1.454.CMB.2.raw
  modified_base (520)..(520): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgataacaaacaacaaacactcctgacccctgcccggttctcacggctccctcgttgggggcaaacgcctacgcccctgacccccgttttcgggcgtcgccgagccctgacggatgaggctgagtattactgcttgctctcctatagtggtgttcgggtgttcgggcggtagggaccaagctgaccgtcgaggtcacgccaaggcctcgtccccctcggtccacgtctcgtcccnccctcctcctacgtctacgctacgcgcggtcg

SEQ ID NO: 365655 - DNA, 534 bp, Homo sapiens
  misc_feature: GZ8MTXP02HLBNF.17.62.F07.1.454.CMB.2.raw
  modified_base (251)..(251): a, c, t, g, unknown or other
  modified_base (285)..(285): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaanagaagcctggccaagcccccaggacactgattangatacaaacaacaaacactcctggacccctgcccggttctcaggctccctcgttggggcaaagcctgcccctgacccctttgggtcgcgcacgcctgagatgaggctgagtattactgcttgcttctcctatagtggtgttcggggtgttcggcgggtaggacctagctgaccgtcgtaggtcagcccaaggctcgcccctggccactcctcgtcccaccctcctcctagtcctacgctgacgtcggcg

SEQ ID NO: 365656 - DNA, 535 bp, Homo sapiens
  misc_feature: GZ8MTXP02GLJ96.17.62.F07.1.454.CMB.2.raw
  modified_base (371)..(371): a, c, t, g, unknown or other
  modified_base (375)..(375): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctggacccctgcccggttctcgggctccctcgttggggcaaagctcgccctgaccctttcgggtncgcngcctgaggatgaggctgagtattactgcttgctctcctatagtggtgttcgggtgttcggcggagggacctaagctgaccgtcgtaggtcagcccaaggctcgccccctcggtccacgtctcgttccaccctctcctaagtctacgctgacgcggctcgg

SEQ ID NO: 365657 - DNA, 545 bp, Homo sapiens
  misc_feature: GZ8MTXP02GS1HX.17.62.F07.1.454.CMB.2.raw
  modified_base (329)..(329): a, c, t, g, unknown or other
  modified_base (542)..(542): a, c, t, g, unknown or other
tcagcgtagactagcacgaccggtgctcgatttagtagtcgcataaagggaaagggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatggtcattatccctatggttccaacagaagcctggccaaagccccccaggacacctgattatgataacaaacaaacaaacactcctaggacccctgcccggttcncacggctccctcgtggggcaaagcctgccctgaccctttggtgcgcagcctgagatgaggctgagtattactgcttgctctcctatagtggtgttcggggtgttcgggcggagggaccaaggctcgaccgtcctaaggtcacgcccgaaagctcgccccctggcctacgtttcgttccccgccctccctcaacgtctacgctgacgccgggtncgg

SEQ ID NO: 365658 - DNA, 553 bp, Homo sapiens
  misc_feature: GZ8MTXP02H98US.17.62.F07.1.454.CMB.2.raw
  modified_base (517)..(517): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaacgcccccaggacactgattatgatacaaacaacaaacactacctggaccccctgccccggttctcacggctccccgtggttcggggcaaaggccctcgccctcgacccgtttcgggcgcgcagcctgagactgagctgagtattactgcttgctctctatagtgtgttggtgttcggcggtaggaccaggctgaccgtcgtaggtcacgccgaagcctcgcccccgtcggcctaccgtcgtccgttcccccnccctccctccgtacgtccgtccgcgtcggcgcggcg

SEQ ID NO: 365659 - DNA, 548 bp, Homo sapiens
  misc_feature: GZ8MTXP02IXV3T.17.62.F07.1.454.CMB.2.raw
  modified_base (517)..(517): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttatgatacaaacaacaaacactcctggacccctgcccggttctcaggcctccctcgttggggcaaagcctcgcccctcgacccgtttcgggtcgcgcacgcctgacggatggaggtctagagttattactgtcttgctctcctatagtggtgttcgggtgttcggcgggtaggaccgaagctcgaccgtcgtaggtcgagcccgaagcctcgcccctggtccactctcgtcccnccctcctccgtagctacgctcgacgtcggcg

SEQ ID NO: 365660 - DNA, 541 bp, Homo sapiens
  misc_feature: GZ8MTXP02GQG50.17.62.F07.1.454.CMB.2.raw
  modified_base (288)..(288): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangataacaaacaacaaacactacctcggaccccctcgaccccggttctcacggccttcccctcggttgggggcaaacgcctcgccctcgaccccgtttcgggtcgcgcagcctgagatgaggctgagtatactgcttgctctctatagtggtgttcgggtgttcggcggtaggacagcgtgaccgctaggcacgccagctcgcccctggcacgtctcgtcccacctcctctacgtctacgcgtcgacgtcggcg

SEQ ID NO: 365661 - DNA, 548 bp, Homo sapiens
  misc_feature: GZ8MTXP02H6C98.17.62.F07.1.454.CMB.2.raw
  modified_base (216)..(216): a, c, t, g, unknown or other
  modified_base (287)..(287): a, c, t, g, unknown or other
  modified_base (442)..(442): a, c, t, g, unknown or other
  modified_base (513)..(513): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattatccctactggttccaacagaagcctggccaagccccccaggacactgattangatacaaacaacaaacactcctacggacccctgccccggttctcacggctccctcgttggggcaaacgcctcgcccctgaccctttcgggtcgcgcagccctggagatgagggctagagtattactgcttgctctcctatgtcgtgtttcgggtnttcgggcggtagggaccagctgacgtccgtaggtcagcccaaggcctcgcccctggtccactctcgtcccnccctacctccgtacgcctacgctcgacgtccggcg

SEQ ID NO: 365662 - DNA, 546 bp, Homo sapiens
  misc_feature: GZ8MTXP02HK6SB.17.62.F07.1.454.CMB.2.raw
  modified_base (287)..(287): a, c, t, g, unknown or other
  modified_base (411)..(411): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctatggttccaacagaagcctggccaagccccccaggacactgattangatacaaacaacaaacactcctcggacccctgccccggttctcacggctccctcggttggggcaaagcctcgcccctgaccctttcgggtcgcgcagcctgacgatggaggtctgagtattacngcttgcttctctatagtggtgttgggtgttcggcggtaggacaagcgtgaccgtcgtaggtcacgcccgaggcctcgccccctggccactcctcgtccccaccctcctccgtacgtctacgctacggcgcggtcg

SEQ ID NO: 365663 - DNA, 543 bp, Homo sapiens
  misc_feature: GZ8MTXP02FR6KG.17.62.F07.1.454.CMB.2.raw
  modified_base (288)..(288): a, c, t, g, unknown or other
  modified_base (375)..(375): a, c, t, g, unknown or other
  modified_base (379)..(379): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttangatacaaacaacaaacactcctggacccctgcccggttctcgggcctcccgtcgttggggcaaagctcgccctgaccctttcgggtncgcngcctgagatgaggctgagtattactgcttgctctcctatagtggtgtcgggttgtcggcggagggacagcgtgacccgtcgtaggtcacgcccaaggctcgcccccgtcggtcacctctcgttccccacctccctcctaacgtcctacgctgacgcggcgtcgg

SEQ ID NO: 365664 - DNA, 598 bp, Homo sapiens
  misc_feature: GZ8MTXP02G84C7.17.62.F07.1.454.CMB.2.raw
  modified_base (252)..(252): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaanagaagcctggccaagcccccaggacactgattatgataacaaaacaacaaaacactaccctcggaaccccctgccccggttactccaacggcctccccgtcggtttcgggggacaaaacggcccctagccccctggacccccgtttcggggtcgccgccgacgccctggacggatggaggtctagagtattactgtcttgctctcctatagtggtgttcgggtgttcggcgggtagggaccaagcgtcgaccgtcctaggtcacgcccgaaagtcctcgcccccgtcggtcccacgttcctcgttccccgtccctcctccgtacgtcctacgctcggacgcgggcg

SEQ ID NO: 365665 - DNA, 543 bp, Homo sapiens
  misc_feature: GZ8MTXP02HUNXC.17.62.F07.1.454.CMB.2.raw
  modified_base (286)..(286): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattangatacaaacaacaaacactcctggacccctgccccggttctcacgctccctcgttggggcaaacgcctgcccctgtaccccgtttcggtcgcgcagcctgacggatgaggtctgtagtattactgcttgctctctagtgtggtgttgggtgttcggcggtaggacagcgtgaccgtcgtaggtcagacccagctcgccccgtggtccactcgtccgtccccgccctcctcctacgtcctacgcgtacgcggtcggcg

SEQ ID NO: 365666 - DNA, 658 bp, Homo sapiens
  misc_feature: GZ8MTXP02FWRTA.17.62.F07.1.454.CMB.2.raw
  modified_base (288)..(288): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcagtgactgtgtccccaggagggacagtcactctcacctgtggctccagcactggagctgtcaccaatggtcattactccctactgttccaacagaagcctggccaacgtccccaggacactgatttangaataacaaaacaacaaacactcctacggacccctgccccggttctcgacggcctcccgtcggtggggacaaagcctcgccctgacccgtttcggcgcgcacgcctggacgatggaggctagagttattactgtcttgcctctaccttagtaggtggttggtttcggggttcggttcggggacgggtacgggaccgtaaggtcgtacggtacccgttccggtacggtccgaacggacccgaaacggtcccgtaccggccccccgttcgggtaccctaccgttccgttcccgtttacccccgtaccccgtttccccctaaccgttaccgttacccgttaccggtccgttacgggaccgggtccgggtccgg

SEQ ID NO: 365667 - DNA, 541 bp, Homo sapiens
  misc_feature: GZ8MTXP02H1MT6.17.62.F07.1.454.CMB.2.raw
  modified_base (286)..(286): a, c, t, g, unknown or other
  modified_base (308)..(308): a, c, t, g, unknown or other
  modified_base (411)..(411): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttangatacaaacaacaaacactccngacccctgccccggttctccaggcctcccgtcgttgggggcaaagccctcgccctcgacccctttcgggtcgcgcagcctggagatggaggctgagtattacngcttgctactcctatagtggtgttcgggtgttcggcgggtaggaccaggctcgaccgtctaggtcagcccaggcctcgcccctcggtcactctcgtccccacctcctctcgtctacgctcgacgcggtcg

SEQ ID NO: 365668 - DNA, 533 bp, Homo sapiens
  misc_feature: GZ8MTXP02J09K6.17.62.F07.1.454.CMB.2.raw
  modified_base (288)..(288): a, c, t, g, unknown or other
  modified_base (375)..(375): a, c, t, g, unknown or other
  modified_base (379)..(379): a, c, t, g, unknown or other
  modified_base (387)..(387): a, c, t, g, unknown or other
  modified_base (402)..(402): a, c, t, g, unknown or other
  modified_base (405)..(405): a, c, t, g, unknown or other
  modified_base (428)..(428): a, c, t, g, unknown or other
  modified_base (435)..(435): a, c, t, g, unknown or other
  modified_base (473)..(473): a, c, t, g, unknown or other
  modified_base (486)..(486): a, c, t, g, unknown or other
  modified_base (530)..(530): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangatacaaacaacaaacactcctcgacccctgccccggttctcgggctcccgtcggtggggcaaacgctccgccctgaccctttgggncgcncgctgagntgagctgagtatacngtntgctctctatgtggtgttcgggngttcggnggagggccaggctcgacgtcgtaggcacgcccaagtcnccgcccctcggcncgtcctcgtcccgccctacctcctgtcctcgctagcgcgggtcncgg

SEQ ID NO: 365669 - DNA, 624 bp, Homo sapiens
  misc_feature: GZ8MTXP02FUDTB.17.62.F07.1.454.CMB.2.raw
  modified_base (289)..(289): a, c, t, g, unknown or other
  modified_base (398)..(398): a, c, t, g, unknown or other
  modified_base (403)..(403): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggaccactgatttangataacaaacaaacaaacactacctacggaccccctacgccccggttctccggggcctccccgttcggttcgggggacaaagcctcgcccctcgacccgtttcggggtnccgcncgcctggaggatgaggctgagtattactgcttgctctccttaatcgttggtgttcgggtgttcgggcgggacggggaccaggtacgtcgacccgttccgtacggtcgacgtcccgaaacggtccgtaccggcccccgtcgggtccctaccgttccttccgttcccccgtcccttcccttccctaacgtcctaccgccgttaggacggtcgggtctacgggg

SEQ ID NO: 365670 - DNA, 631 bp, Homo sapiens
  misc_feature: GZ8MTXP02I7HE3.17.62.F07.1.454.CMB.2.raw
  modified_base (160)..(160): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcactggagctgtcaccaatggtcattatccctatggttccaacagaagcctggccaagcccccaggacactgattatgatacaaacaacaaacactctcggacccctgccccggttctcacggcctccccgtcgttcgggggcaaacgccgtacgcccctgacccccttttcggggtcgccgcgacgccgtgacggtatggaggctaggagttacttactgtcttgccttcctccttaagttggtcggttggtttcggggttggtttccgggcggggtaagggtaccgaaggtccgtacggtacccgtccgtacggtacgcgacccgaagggtcctccggcccccttcgggtcctaccgttccgttccgttacccctccccctccttaacccgtcgtaccgtacgcgttacgcggttcggccg

SEQ ID NO: 365671 - DNA, 690 bp, Homo sapiens
  misc_feature: GZ8MTXP02H3PEP.17.62.F07.1.454.CMB.2.raw
  modified_base (250)..(250): a, c, t, g, unknown or other
  modified_base (254)..(254): a, c, t, g, unknown or other
  modified_base (283)..(284): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactcctatggtccaangaancctggccaacgccccaggacactgattannataacaaacaacaaacactacctacgacccctcgtcccggttctcgacggtcctccccgtcggttcgggggacaaaacggtcctacgtcccccgtcggtaccccgtttcgggtcgtccgcgacgccgtaggagtactggacgtcgtagtagttattacgtcgtcttcgtcttcctacttagtaggtggttcggttcggggttggttccggggcgggtaacgggggacccaaagggtccgtacggtaaccggttccgttaacgggtacgtaccccggaaagggtcccgtaccggtccccccgtcggttacccaaccgtttccctccggtttacccccaccccgtttcccgtaccctttaaccgtccgttaaccggcgttacgggtacccggccgggttcgtaccggg

SEQ ID NO: 365672 - DNA, 587 bp, Homo sapiens
  misc_feature: GZ8MTXP02IKOP0.17.62.F07.1.454.CMB.2.raw
  modified_base (217)..(217): a, c, t, g, unknown or other
  modified_base (294)..(294): a, c, t, g, unknown or other
  modified_base (319)..(319): a, c, t, g, unknown or other
  modified_base (387)..(387): a, c, t, g, unknown or other
  modified_base (391)..(391): a, c, t, g, unknown or other
  modified_base (399)..(400): a, c, t, g, unknown or other
  modified_base (402)..(402): a, c, t, g, unknown or other
  modified_base (411)..(411): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactgganctgtcaccaatggtcattactccctacttcggttaccaacagaacgcctcggccaacgcccccaggacactgattangaataacaaacaacaaacacctccncgaccctgtcccggtcgtccgggcctccgtcggtggggacaacgctccgccctcgtcccgtttcggcncgcngcctgagnngngctagattntacgtgtctcgtctctcttagtggttggtggttcgggtggtcgggagggtacgggacacggtcgtacgacccgtcgtaggtcacggacccgaggtccctccgtccccgtcgtcctaccttccttcccgttccccacctcccttacgtcgtaccgtcgtcgtcggcggcgcgtacgg

SEQ ID NO: 365673 - DNA, 528 bp, Homo sapiens
  misc_feature: GZ8MTXP02I4TM4.17.62.F07.1.454.CMB.2.raw
  modified_base (286)..(286): a, c, t, g, unknown or other
  modified_base (379)..(379): a, c, t, g, unknown or other
  modified_base (410)..(410): a, c, t, g, unknown or other
  modified_base (443)..(443): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattangatacaaacaacaaacactcctggacccctgcccggttctcaggcctccctgttcggggacaaacggcctgcccctgtacccctttcgggtcncgcgacgcctgacgatgaggctgagtatacngcttgctctctatgtgtgttcgggtgttacggnggtaggacgagctcgccgtcaggtcacgccaaggctcgcccctggcactctcgtcccgcctcctctacgtctacgctcgcgcgcg

SEQ ID NO: 365674 - DNA, 795 bp, Homo sapiens
  misc_feature: GZ8MTXP02HXXU0.17.62.F07.1.454.CMB.2.raw
  modified_base (424)..(424): a, c, t, g, unknown or other
tcagcgtagactagcacgaccggtgctcgatttagtagtcgcataaagggaaaggggtcccttccaataatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatcggttccaacagaagcctggccaacgcccccaggacactcgattatagatacaaacaaacaaacactcctcggacccctcgcccgttctcacggcctcccgtcggttacgggggacaaacggccctcgacccctcggtaccccgtttcggggtcgccgtcacggtcccgtaggacgggtanggaacggtcgtaggtaaagttactttaacgtgtcctttggcctttccttaccttagtaacgggttcggggttaggtttcgggggttcgggtttaccgggggacggggtaaggggtaacccgaaaggggtcccgtttacgggaaacccccggtttccggttaacggggttaccgtaaaccggggtaccccccgaaaagggggtcccctttaacccggggaccccccccgttttacgggggttcccctttaaacccggtttttcccccggtttaccccccggtaccccctttacccccgttcccgtttaacccgggtaccgttaacccggtccgttaaaccggggaccggtcccggggtcggttaacccgggg

SEQ ID NO: 365675 - DNA, 628 bp, Homo sapiens
  misc_feature: GZ8MTXP02JXWK6.17.62.F07.1.454.CMB.2.raw
  modified_base (287)..(287): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggcattactccctatcggttccaacagaagcctggccaacgcccccaggacactgattangataacaaacaacaaacactacctcggaaccccctgtcccggttctccgacggtcctcccgtcggttggggacctaaaggccctacgccctcgtacccgtttcggggtcgcgtcgacgccgtaggacggagtggaacgtcgtaggagtttaacgttacgtcgtcttgtcctctaccttagttacggtggttggtttcgggtgttcggggcgggtaggacgaaggtctcggaccgtcgtacggtcgacgccgtaaacggccgtccgtccccgtcggtactacccgttcgtccgtccccgtcccttcccgtcgtcggtaccctacggctcggcggtcggtccg

SEQ ID NO: 365676 - DNA, 690 bp, Homo sapiens
  misc_feature: GZ8MTXP02JKWDK.17.62.F07.1.454.CMB.2.raw
  modified_base (402)..(402): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtccaccaatggtctattactccctactcggttaccaacagaagcctggccaacgcccccaggacactgtatttacagataacaaacaaacaaacactcctcgacccctcgacccgttctcacgcctcccgtcggttggggacaaacgccgtcgcccgtcgtacccgtttcgggcgtcgccgngcgtgaggagtggagcgtacgtagttaacgttcgtcgtcgttcgtactcctcgttagttagggttggttcggtttcgggttacgggttccggggtacgggtaacgggggaccgtaggtaccgttaccgggtaccgttaccggttaacggtccgaccggacccgtaacggccccgttcccggacccccgtttccgggtaccctaccgttcccgttccccgttacccctcccccgttcccgttcccgtaacggttcccctccggtacgttacgaccgggggtcggtccgg

SEQ ID NO: 365677 - DNA, 755 bp, Homo sapiens
  misc_feature: GZ8MTXP02I2ER9.17.62.F07.1.454.CMB.2.raw
  modified_base (216)..(216): a, c, t, g, unknown or other
  modified_base (287)..(287): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattatccctatggttccaacagaagcctggccaacgcccccaggacactgatttangataaccaaacaacaaacactcctacggaccccctgccccggttctccgacggtccttaccccgtggttcgggggactaaacggccctcggcccctagtacccccgttttcggggcgccgtcgacgcccgttggacggtagtggacgggtacctggaagttaacgtttacgtggtcctttgccttccttaccgttaattagggttcgggttcgggtttcgggggttcgggtttaccggggacggggttaagggggaacccctaagggtcccgttacgggaaccccggttccgttacggggtaccacggtacccccgaaaagggtcccgttacccggtccccccggttcgggttacctaaacccgtttcccgttcccggtttaacccccctaccccgtttccccgttaacccttaccggttcccgtttaacccggccgtttaaccgggacggggtcccggggtttccgg

SEQ ID NO: 365678 - DNA, 722 bp, Homo sapiens
  misc_feature: GZ8MTXP02IVMBX.17.62.F07.1.454.CMB.2.raw
  modified_base (155)..(155): a, c, t, g, unknown or other
  modified_base (286)..(286): a, c, t, g, unknown or other
  modified_base (391)..(391): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcagganccctcactgactgtgtccccaggagggacagtcactctcacctgtggctccagcactggagctgtcaccaatggtcattactccctactggtaccaacagagcctggaccaacgccccagacactgattangaactaacaaacaacaaacacctccgtacggacccctgcccggttcgtccggtcctcccgtcggtcggggcaaacgtctccgccctcgtccgttcgggcgccgcncgtcctaggacgtgtaggaggtcgtagtagtattacgtgtcgttcgcttactaccgttagttacgggttgggttacgggtttcggggttcgggttaccgggcggggaacgggtaccgtaacgggtcgtaccgggtacccgttaccggtaccgggttaccgaaccgggtaccccgtaaacgggtcccgtacccccgggttacccccgttccggttcccgttacccgttcccgtttccccggtttacccccggttccccctttaaccccgttcccggtttaaccgtcccgttaccggtaccggtacggaccgggtccggggtcggtaccgggg

SEQ ID NO: 365679 - DNA, 578 bp, Homo sapiens
  misc_feature: GZ8MTXP02FL9FL.17.62.F07.1.454.CMB.2.raw
  modified_base (286)..(286): a, c, t, g, unknown or other
  modified_base (547)..(547): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattangatacaaacaacaaacactcctcgacccctgccccggttctcacggcctcccgtcgttgggggcaaagccctagcccctgtacccctttcggggtcgcgcacgccgtgacggatggaggtctgagtattactgacttgctctctatacgtggtgttgggtgttcgggcggagggtaccaaggccgtacggaccgtccgtaggtcacgacccgaaggcctaccggccccctggtccacgttcctccgttccccacccttccncccgtagtacctacgcgtacgacggcggtcg

SEQ ID NO: 365680 - DNA, 729 bp, Homo sapiens
  misc_feature: GZ8MTXP02IVQU3.17.62.F07.1.454.CMB.2.raw
  modified_base (294)..(294): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactccctatggttaccaacagaagcctcggaccaacgcccccaggaccactagatttangaataacaaacaaacaaacacctacctcggacccctgtccccgttcgtcccgggtcctcccgtcggttcggggaccaacgtcctaccgcccgttcgtaccccggtttcgggcgtaccgcgacgtccgtggaacggtagtaggacggtcgtagggtaacgttactttaccgtggttaccttcggtacccttcttaccgttaagttacggggtttgggttacggggtttccgggggttgggttcccggggagggtaccggggaacctaacgggtcgtaccggtaacccgttcgacggttccgacggaccccgtaaggtcccgtcccggtcccccgtcggttaccctacttcccgttacccggttaccccctaccccgttcccgttaccgttaaccgtccgttaaccgcggtaacggccgggtcgtaccggtaacggg

SEQ ID NO: 365681 - DNA, 691 bp, Homo sapiens
  misc_feature: GZ8MTXP02HEURU.17.62.F07.1.454.CMB.2.raw
  modified_base (235)..(235): a, c, t, g, unknown or other
  modified_base (251)..(251): a, c, t, g, unknown or other
  modified_base (329)..(329): a, c, t, g, unknown or other
  modified_base (366)..(366): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattntccctatggttccaangaagcctggccaacgcccccaggacactgattatgatacaaacaacaaacactcctgacccctgcccggtctcagtcnccctgtggggcaagcctagccctgacccgtttcgggngcgtcacgtcctggaggtactggagggccctgtaagttacttaacgtgtcgtttgacttccgttaccttagttacgggttggttcgggtttcgggggtcggttttcggggacggggtacgggggaacctaacgggtccgttaccggaacccggttccgtacgggttaccgaccgggtaccccgaaaacggggtccgttacccggcccccccggttagggtcccgtaaacccttaccgttcccggtttaccccccgtaaccctttccccgttcccgttaaacggtcccgtttacccgtaccgttacgtaccgggggccggtccggg

SEQ ID NO: 365682 - DNA, 574 bp, Homo sapiens
  misc_feature: GZ8MTXP02HOS56.17.62.F07.1.454.CMB.2.raw
  modified_base (528)..(528): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttaccaacagaagcctggccaagcccccaggacactgatttatgaataacaaacaaacaaacacctacctcggacccctcgccccggttctccacggccttcccgtcggttcgggggaccaaacgcccgttcgcccctcgtaccccgtttcggggtcgcgtcacgcctggacggatggagctgagttattactgcttgcttctctagtcgtggttgttgggtagttcgggcgtagggaccagctcgaccgtcgtaggcacgccgagctcggcccctggaccncgtctaccgtcccaccctctccgtagcctacgctcgacggtcgcgg

SEQ ID NO: 365683 - DNA, 668 bp, Homo sapiens
  misc_feature: GZ8MTXP02GP6ED.17.62.F07.1.454.CMB.2.raw
  modified_base (160)..(160): a, c, t, g, unknown or other
  modified_base (218)..(218): a, c, t, g, unknown or other
  modified_base (293)..(293): a, c, t, g, unknown or other
  modified_base (650)..(650): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctnactgactgtcgtccccaggagggacagtcactctcacctgtcggctccagcactgganctgtcacaatgtctattactcctactcggttaccaacagaacgcctggccaacgccccaggaccactgtatttangaactaacaaaacaacaaacgtacctaccgtacgacccctcggtaccccggttctaccgacggtccttcccgtacggggttcgggggaactaaacggcccctccgtcccgttacgtacccccggttttcggggcgcgtccgacgtcgtacggacggtagtggacggtcgtagtagttaacttcgtcggtcttcgacttccgtcttaagtcggttgggttcggttcggggttggttcggggacggggtaacgggaccaaggtcgtaccgaccgttccgtagtacgcgtaccgaggccctcggcccccgtggtacctcttccgtccctaccctcccttacctccgttacgtcctaccgngtcggacggtcggtacgg

SEQ ID NO: 365684 - DNA, 592 bp, Homo sapiens
  misc_feature: GZ8MTXP02H5EXQ.17.62.F07.1.454.CMB.2.raw
  modified_base (287)..(287): a, c, t, g, unknown or other
  modified_base (470)..(470): a, c, t, g, unknown or other
  modified_base (483)..(483): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtggctccagcactggagctgtcacaatggtcattctcctatggtccaagagaagcctggccaacgcccccgaggaccactgattangataacaaaacaacaaacactacctacgaacccctcgccccgttctcacggcctcccgtcggttcggggacaaacgccctacgccctcgtacccgttcggggtcgcgcacgccgtaggaggatggagctagtacgtattactgtcttgtctctctaagtggttggttgttcgggtgttcgggnggtaggacagtcnggacccgtcgtaggcgacgcccgaacggcctcccgccccgtacggccaccgttcctcccgttccccacccttcccgttcctcgtcctaccgtcgacgaccggcggaccg

SEQ ID NO: 365685 - DNA, 641 bp, Homo sapiens
  misc_feature: GZ8MTXP02JEY7X.17.62.F07.1.454.CMB.2.raw
  modified_base (219)..(219): a, c, t, g, unknown or other
  modified_base (295)..(295): a, c, t, g, unknown or other
  modified_base (418)..(418): a, c, t, g, unknown or other
  modified_base (580)..(580): a, c, t, g, unknown or other
  modified_base (598)..(598): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcaccgtgtggcctccagcactgganctgtcacaagtgtcattactccctatggttaccaagagaacgcctggacccaacgcccccaggaccactgtattangaataacaaaacaacaaaccacctcctaccggacccctcggtaccccggttcgcccgggccttacccggtcgggtcggggaccaaacggtcctaccgtccctcggtacccgttcggcgcgtcncgcctaggaggtatcgggaggtcctaggtagttattacgtcgtctgtctactccgtagtcggttggttcgggtggttgggtcggtacggggacggacgtaaggtccgtacggtaccgtccgtaggtaccgacgaccgacgtcgacccgtcccgtcggtaccnccgttctaccgttccccnccttcccacgttccgtctacgtcgtacggcggtcggcgtacgg

SEQ ID NO: 365686 - DNA, 636 bp, Homo sapiens
  misc_feature: GZ8MTXP02GAWU0.17.62.F07.1.454.CMB.2.raw
  modified_base (291)..(291): a, c, t, g, unknown or other
  modified_base (337)..(337): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttaccaacagaacgcctggccaacgcccccaggacactgatttanagataacaaacaacaaacactcctacggaccccctgccccggttcncacggcctcccgtcgttggggacaaaggccctcgccctgtacccgtttcgggcgcgcgcgccgtgacggatggaggtcgtagtagttacttacgtgtcttgcttcttccttaagtagttgggttgttcggggttacggttcggggacgggtaggggaacctaagggtcgtccggtaccggtcggttaggtaccacggacccgaacggtcccgtccggtcccccgtcgggtaccctaccggttccgttccgttccccgaccccttccgtcctacggttctaccggcgtcgcggcggtcgg

SEQ ID NO: 365687 - DNA, 707 bp, Homo sapiens
  misc_feature: GZ8MTXP02GU1N0.17.62.F07.1.454.CMB.2.raw
  modified_base (289)..(289): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaacgcctggaccaacgcccccaggacactgattangataacaaacaaacaaacactcctacgacccctcgtcccggttctcgacggtcctcccgtcggttcggggactaaagcccgtcgccctacgtacccgtttcgggtcgccgcgacggccgtaggaggtacgtgggacggcttaggtaagtttacttacgtcgttcttcggtccttccgttacgttacgttagggttcgggtttcgggtttcgggggttcggtttaccgggggcgggggtaacggggtaccgtaacggtccggttacggtaccccggttacgtacgggtaccaaccgggtacccgtaaacggtcccgttcccggtacccccgttcgggtccctaccgttccgttacccgttaccccctaccccgttccttaacccgtacgtccctaccgtcgtcggtacggccgggtccg

SEQ ID NO: 365688 - DNA, 591 bp, Homo sapiens
  misc_feature: GZ8MTXP02JTCU5.17.62.F07.1.454.CMB.2.raw
  modified_base (245)..(245): a, c, t, g, unknown or other
  modified_base (249)..(249): a, c, t, g, unknown or other
  modified_base (271)..(272): a, c, t, g, unknown or other
  modified_base (274)..(274): a, c, t, g, unknown or other
  modified_base (291)..(291): a, c, t, g, unknown or other
  modified_base (306)..(306): a, c, t, g, unknown or other
  modified_base (356)..(356): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcacaatggtcattatcctatgtcanaganctgcagcccagacactgattannanaacaacaacaacactcncgacctcgtccgtcncgacgtcctccgtcggtcggacagcctcgccgtcgtaccgttggcgcgcncgcgtaggagtagtcggagtcgtagtacgttagtacgtcgtcttcgtcttcctacgttagttaggttggttcggttcgggtcggtacgggacgggtacggtacaggtccgtacggtaccgtcgtacggtacgacgtaccgacgtcccgtaccgtccccgtcgtacctccgttccgttcccgtccccgtccccttaccgtaaccgtcgtaccgtaccgtcgacggacggtcggtcg

SEQ ID NO: 365689 - DNA, 778 bp, Homo sapiens
  misc_feature: GZ8MTXP02JMZOI.17.62.F07.1.454.CMB.2.raw
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtggcctccagcacgtggagctgtaccacaagtgtactattactccctagtcggttaccaacgagaacgcctcggacccaaccgcccccgaaggaccacgtacgtatttactagaactaaacaaacaaacaaacctactccgtacgacccctcgtccccgttctacgacggtcctcccgtcgggttacggggactaacgtccccgtaccgtcccgtaccgtacccggtttcggcgccgacgcgtccgtaggacggtacgtcgggacggtacgtaggtacgtttaaacgttcgtgttccgtttcgtcctttcccggttacccgtttaggtttaacggggttcggggtttacggggtttccgggggttcggtttaccgggggacggggttaaaccggggaccgtaagggtcccgttacggtacccggttacgggtaccggtaccgtacccggtaaccggaaccggttcccgtcccggtccccccggttcggttaccccgttccgttccccgttcccgttcccccgtcccccttaaccgttcccgtcgtttcccgaccgtcggtacggccggacggtccgg

SEQ ID NO: 365690 - DNA, 879 bp, Homo sapiens
  misc_feature: GZ8MTXP02FHGT4.17.62.F07.1.454.CMB.2.raw
  modified_base (289)..(289): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactccctatggttccaacagaagcctggccaaacgcccccaggacactgattangataacaaacaacaaacactacctcggacccctgaccccggttctccgaacggtccttaccccgttcggttacgggggcctaaaaggtcccctacggaccccctggtacccccgttttcggggtcgcggtccacgggtcccttagggacgggtaattcgggaaacgggtcccgttaagggaacgtttaacgttaacccgtttggtccgtttaacgggtaccctccggttaccctttaaacgttaggggtttacggggttacgggttttaccggggggttacgggtttcccgggggtaccgggggtaaaccgggggtaaccccttaaaacggggtccgttacccgggtaaaccccgggtttacccgttaacgggggtttacccgtaaccggaaccccccggtaaaacggggtaccccgtttcccgggaaccccccccgtttaccggggttcccctaaacccggtttccccgtttaccccggggttttacccccccgggcccccgttttaccccccttaacccggtttaaacccggtttcccgtaaccccggttcccggttacgggtaacccggggtcccggggtacccggg

SEQ ID NO: 365691 - DNA, 627 bp, Homo sapiens
  misc_feature: GZ8MTXP02GUN0A.17.62.F07.1.454.CMB.2.raw
  modified_base (251)..(251): a, c, t, g, unknown or other
  modified_base (282)..(282): a, c, t, g, unknown or other
  modified_base (292)..(292): a, c, t, g, unknown or other
  modified_base (543)..(543): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactcctatggttccaangaagcctggccagccccaggcactgatttangataacaaanaacaaacgtacctaccacggacccctgtaccccgttctacgacggtccttcccgtcgggttcggggactaaacggccctaccgcccttcggtaccccgtttgggcgcgccgcgtacccgtgaggagtcggagtacctgtaagtcttactggtcttacgcctctacgtaagttgggtggttcggtttcggggtggttcgggacgggaggtaaccaggtccgtacggtaccctcggttagaccgacgaacccngggccctccggcccgttacggtccaccttcgttaccctcccctaccttccaacgttcgtacctcgtccgtacgcggttcggacg

SEQ ID NO: 365692 - DNA, 669 bp, Homo sapiens
  misc_feature: GZ8MTXP02JS9W2.17.62.F07.1.454.CMB.2.raw
  modified_base (216)..(216): a, c, t, g, unknown or other
  modified_base (252)..(252): a, c, t, g, unknown or other
  modified_base (289)..(289): a, c, t, g, unknown or other
  modified_base (387)..(387): a, c, t, g, unknown or other
  modified_base (403)..(403): a, c, t, g, unknown or other
tcagcgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactccctatggttccaanagaagcctggccaacgcccccaggacactgactttangataacaaacaacaaacactcctggacccctgcccgttctcgacggcctacccgtcggttacggggctaaagccctcgcctcggtacccgtttgggcncgtcacgcgtgacggntcgacggctagacgttattcgcgtcgttcgccttctaccgtaagttcgggttcgggtttcgggttaccgggggttcggtttccggggacggggtaacgggtaaccgaacgggtccgtaccggtaaccggttccggtaaacggtccgtaaccggacccgtaaaggtccctcccgggttaccccccgtgggttacccacgttaccgtcccgttacccctacccgttcccgtaacgtcgttaccgtacgtcgtcggacggtcggtccgg

SEQ ID NO: 365693 - DNA, 595 bp, Homo sapiens
  misc_feature: GZ8MTXP01CDQLK.10.73.G07.1.454.CMB.2.raw
  modified_base (222)..(222): a, c, t, g, unknown or other
  modified_base (231)..(231): a, c, t, g, unknown or other
  modified_base (575)..(575): a, c, t, g, unknown or other
tcagcatagtagtgcacgaccggtgctcgatttagctctacgctcagggggcaggagtcagtctcagtcaggacacagcatggacatgagggtccccgctcagctccgtggggctcctgctactctggctccgaggtgccagatgtgacatccaaatgacccagtcctccatccctccctgtctgctattcttaggcacagagtcacctattactggccggnaagtcaganctaattaccaacttctttaaagttggttacaacaggaggaccgaaggaacgcccctaagcctccgtggtctagtggtgcatccatgtacgacaaacgtcgggtcccagtccgtaggttcaggtcggctaggtcggtagtttgggactagtatttcactcacacctatacaactatctgcagtcctagatgtacgttacacttaactttactacttagtaacaaacgtacgtaacgttaaccgaacggtaacctacctaaacgtccttaccgtttcccgggaacccgtaagggaaacctaaaggttgtaatacgttaaccgaggttaccgtaacgtgggtcgtcncgacctaacttaacgttccg

SEQ ID NO: 365694 - DNA, 629 bp, Homo sapiens
  misc_feature: GZ8MTXP01A914D.10.73.G07.1.454.CMB.2.raw
  modified_base (224)..(224): a, c, t, g, unknown or other
  modified_base (268)..(268): a, c, t, g, unknown or other
  modified_base (288)..(288): a, c, t, g, unknown or other
  modified_base (316)..(316): a, c, t, g, unknown or other
tcagcatagtagtgcacgaccggtgctcgatttagctctacgctcagggggcaggagtcagtctcagtcaggacacagcatggacatgagggtccccgctcagctcctggggctcctgctactctggctccgaggtgccagatgtgacatccaaatcgacccagtctccatccctccctgtctgcattctttaggcacagagtcacctattacgttggccgggnaagtcagagctacttaccaacttacttttaaattggtttacaanaggacggaccgaagggaacncccctaagcctccgtggtctagtggtcncactccatgtacgacgtaaacgtcggggtaccagtccgtaggttcaggtggcgtaggtaggtagtttgggactagtacttcactctacactactacaaatactctacgcacggtcctagacttagtactttaccgacttaaacctttacgtacttcgtaactaaacgtaagtaacgttaaccgacgtaaccgacctaactaccgttacccgtttccgggaacccgtaacgggttaaacctaaagggttcggtaattaacttacgaaggttacgtaaccgttgggtcggtacctcggaccctaacctttcgttc

SEQ ID NO: 365695 - DNA, 656 bp, Homo sapiens
  misc_feature: GZ8MTXP01AL07B.10.73.G07.1.454.CMB.2.raw
  modified_base (217)..(217): a, c, t, g, unknown or other
  modified_base (315)..(315): a, c, t, g, unknown or other
tcagcatagtagtgcacgaccggtgctcgatttagctctacgctcaggggggcaggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcacattactgccggnaagtcagagctattaccaacttctttaaattggtttacaaacgaggacggaccaaggggaaaccgccccctaaagccttccctgggtcctagtgggtncatccccatgtacgaccaaacgttcgggggtaccccagttcccgaaggtttccaggttcgggacctagggttagggtaagtttcgggggaactaggttacttttccaaccttctaccaaccctattaaccaaaacgtaactcccgttaggaccacggtcccttaggtaacttaggttactttaccgaacttaaaccctttagtacctagttaccaaacgtagtaccgtacacggaccactaactcctacgtttccggaacccgtagggaacctaaagggcgtaataacgttaccgaaaggcccgtaaagtcggtaacggctaggccctaaccttgtttccc

SEQ ID NO: 365696 - DNA, 522 bp, Homo sapiens
  misc_feature: GZ8MTXP02G4TZV.10.73.G07.1.454.CMB.2.raw
  modified_base (262)..(262): a, c, t, g, unknown or other
  modified_base (373)..(373): a, c, t, g, unknown or other
  modified_base (379)..(379): a, c, t, g, unknown or other
tcagcatagtagtgcacgaccggtgctcgatttagctctacgctcaggggcaggagtcagtctcagtcaggacacagcatggacatgagggtcccgctcagctcctggggctcctgctactctggctccgaggtgccagatgtgacatccaaatgacccagtctccatcctcctgtctgcatctttaggcacagagtcaccattactgccgggcaagtcagagcattacaactcttaaatggttcaacagagccagggaaancccctaagctcctggtctatggtgcatccactgtgcaaactggggtcccatccaggtcagtggcagtggatttggggacagatttcactctcaccatcaaacaatctgcanctgatntattcgtactaacttaactactagtacaacaagtaacgtacgacgaacgaccaactactacgttaccgtacccgtacggaaccgtaaacgtaggtaacgtactacaacgacgtaacgtacgtacggtacgtcgacaccactac

SEQ ID NO: 365697 - DNA, 497 bp, Homo sapiens
  misc_feature: GZ8MTXP02FNF33.10.73.G07.1.454.CMB.2.raw
tcagcatagtagtgcacgaccggtgctcgatttagctctacgctcagggggcaggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaacttctttaaattggtttcaacagaggccagggaaagcccctaagctcctggtctatggtgcatccatgtgcaaactggggtccatcagtcagtgcagtggatttgggacagtatttcactctcacatacaaacaatctgcagcctgatgattcgactaacttactactgtacaacagacgttacacgacgacaatctactttcgccgtaggaccaaagtgatacgtacaagtcgaaagtgtacggctcgacacctattcc

SEQ ID NO: 365698 - DNA, 540 bp, Homo sapiens
  misc_feature: GZ8MTXP02I43CO.10.73.G07.1.454.CMB.2.raw
  modified_base (435)..(435): a, c, t, g, unknown or other
tcagcatagtagtgcacgaccggtgctcgatttagctctacgctcagggggcaggagtcagtctcagtcaggacacagcatggacatgagggtccccgctcagctcctggggctcctgctactctggctccgaggtgccagatgtgacatccaaatgacccagtctccatcctccctgtctgcatcttaggcacagagtcaccatttacttgccgggcaagtcagagctattaccaactactttaaattggttcaacagaggaccagggaaacgcccctaagctcctggtctatggtgcatccactgtgactaaacgtcggggtcccatccaggttcagtgcagtggtatttggggactagtatttacacttctcaaccatacaaactaatctgacacgcctagtatgtattcgactaattactactgtaccaanagtaactacgacgacgactaatctaacgtttccggaccgttaggaaccctaaagtaggtaatacgtaccaagtacgaacgttgcggactcgactacctatttccg

SEQ ID NO: 365699 - DNA, 534 bp, Homo sapiens
  misc_feature: GZ8MTXP02IYB02.10.73.G07.1.454.CMB.2.raw
  modified_base (219)..(219): a, c, t, g, unknown or other
  modified_base (269)..(269): a, c, t, g, unknown or other
  modified_base (292)..(292): a, c, t, g, unknown or other
tcagcatagtagtgcacgaccggtgctcgatttagctctacgctcagggggcaggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccatttactgccgggnaagtcagagcattaccaactctttaaattggttcaacagaggcaggaacncccctaagctctggtctatggtncatccactgtgacaaacgtggggtcccatccaggtcagtgcagtggtattggggacagtatttcactctacacctatacaaactaatctgacagcctagactgtattcgactaactttactactgtacaactagacgttacacgacacctatctacgttccggacccgtagggaaccaaaggtggattaacgacaacgacgtaaacgttggtacggtcctaggacctaaccgtacgtttccg

SEQ ID NO: 365700 - DNA, 760 bp, Homo sapiens
  misc_feature: GZ8MTXP02IUFE9.10.73.G07.1.454.CMB.2.raw
tcagcatagtagtgcacgaccggtgctcgatttagctctacgctcagggggcaggagtcagtctcagtcaggacacagcatggacatgagggtccccgctcagctcctggggctcctgctactctggctccgaggtgccagatgtgacatccaaatgacccagtctccatccctccctgtctgcattctttaggcgacagacgtcacctattacgttcggccgggacaagtcagagctacttaacctaacttactttaaaattggtttacaaacgtaggacgggaccgaaggggaaaccgcccctaagccttccgtaggtctagtggtcacactccacgtgtcgacctaaacggttccgggggtacccctaagtccgtaacgggttccgaaggtcggtcgtaggttagggtagtttgggggactaggtactttcacttctaccaactaactacaaactaatcgtacgacctacgccgtaggtattacggtaactttttaccgaccctttaaaccgtttaaccttaccgttacggtaaaccctaaacgtaaacggttaaaccggtttaaccgaacccggtaacccggtaaccctaaaactttacccccgttaacccggttttacccggggtaccccggttaaacgggggaaacccttaaaaggggttcgggttaaaactacgttaaaccggaacggtaccgttaaacggttcggggtttacgggcccgttaacggacccttaaacccgtttacgtttcccg

SEQ ID NO: 365701 - DNA, 695 bp, Homo sapiens
  misc_feature: GZ8MTXP01CRZ2M.51.53.E09.1.454.CMB.2.raw
  modified_base (317)..(317): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgactattgtacttatattctgtctctgtaccaacaactacccgacaaacgtcccaaatcatgatcttgagtcagtgacgtccggccgngtagggttctcatcgcttccgtccccggctaccgaagtctcggacacgccgaccggtccctcccgtcgacctatccgtcgtcgggctccggaggtcgtaggacggacgtaggtcttagtaatttactacgtcgacgtagggtactaactaaacgttaaactaaaccgaaaaaccgtaacggtaaaaccgttacggggtttcgggggttaccgggttacccgggggaccggggtaacccgggaaacccgtaaaacccgttccgggtaaccccgttaccgttaacccggtccaacccgggccccgttaacggggtcccttccccgggtcccccgtttacgggtacccttcccgttcccgtttccccgggtttcccccccg

SEQ ID NO: 365702 - DNA, 546 bp, Homo sapiens
  misc_feature: GZ8MTXP01C56ZE.51.53.E09.1.454.CMB.2.raw
  modified_base (386)..(386): a, c, t, g, unknown or other
  modified_base (425)..(425): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgagtcagtgatcggcccgcagggggtttctcatcgcttctccccggctccaagtctggcagcacggccctcctcgaccatcncgtgggctccaggctgaggacgaggctgattatactgcnggctcatataacaaacagaaactacgttggggtagttcgggcgggcgggaaccaaacgttcgacccgttcctacgtcacgcccaacggctccgccccgtcggcactccttcgttaaccccc

SEQ ID NO: 365703 - DNA, 530 bp, Homo sapiens
  misc_feature: GZ8MTXP01CA745.51.53.E09.1.454.CMB.2.raw
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgagtcagtgatcggcccgcaggggtttctcatcgcttctccccggctcaagtctggcagcacgggccctccctgaccatctctgggctccaggctgaggacgaggctgattatactgcaggctcatataacaaacagaaacacgttgggtgttcgggcgcggggaaccaaacttgaccgttccgtacgtcacgcccaaggctcgcccctggtcactcgttcgttcccc

SEQ ID NO: 365704 - DNA, 526 bp, Homo sapiens
  misc_feature: GZ8MTXP01BPA9F.51.53.E09.1.454.CMB.2.raw
  modified_base (369)..(369): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcctagtctgccctgactcagcctgcctccgtgtctgggtctcctggacagtcgatcaccatctcctgcactggaaccaccaatgacattggtacttataattctgtctctgtaccaacaatacccggcaaagtcccaatcatgatctttgagtcagtgatcggcccgcaggggtttctcatcgcttctccccggctcaagtctggcagcacggcctcccngaccatctctgggctccgagctgaggacgaggctgattatactgcaggctcatatacaaacagaaactacgttgggtgttcggcgggcgggaaccaaacgttcgacccgttcgtacgtcacgccaaggctccgcccctggcacctcgttcgtccccg

SEQ ID NO: 365705 - DNA, 554 bp, Homo sapiens
  misc_feature: GZ8MTXP01A0Z5F.51.53.E09.1.454.CMB.2.raw
  modified_base (437)..(437): a, c, t, g, unknown or other
  modified_base (542)..(542): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacattggtacttataattctgtctcctggtaccaacaactaccccggcaaacgtccccaaactcatgatcttgagtcagtgatcggcccgcgaggggtttctcactcgcttctccccggctcaagtctggacagccgaccggccctccctcgaccatctcgtcgggcctccgaggcctggagggacgaggtctagtattattacngcacggctacataacgtaacaaacagaaactacgttggggtagttcggcggccggaacaaacgttcgacccttcgacgtcacgccaaggcctccgcccctcggcnctcgttgttccc

SEQ ID NO: 365706 - DNA, 512 bp, Homo sapiens
  misc_feature: GZ8MTXP01AECCY.51.53.E09.1.454.CMB.2.raw
  modified_base (478)..(478): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtcccaaactcatgatcttgagtcagtgatcggccgcagggtttctcatcgctctcccggctcaagtctggcagcacggcctccctgaccatctctcgggctccagctgaggacgaggctgattatactgcaggctcatatacaaacagaaacactggtgttcggcggcggaaccaacttgaccgttccgtacgtcngccaaggctgcccctcggcactcgttcgttcccc

SEQ ID NO: 365707 - DNA, 540 bp, Homo sapiens
  misc_feature: GZ8MTXP01DEZMW.51.53.E09.1.454.CMB.2.raw
  modified_base (338)..(338): a, c, t, g, unknown or other
  modified_base (443)..(443): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtacaacaatacccgcaaagtcccaaactcatgatcttgagtcagtgatcggctcgcaggggtttctcatcgctttccnccggctccaagtctggcaagcaccggccctccctcgacctatctctgggctccaggctgaggacgaggctgatattactgcagctcatataacaaacagaaaacncgttagggtcgttcgggcggaacgggaaccaaacgtcgaccgtacctacgttacgcgacccgaaggcctcgccccctggttcctccttccgttcccg

SEQ ID NO: 365708 - DNA, 639 bp, Homo sapiens
  misc_feature: GZ8MTXP01DCEX8.51.53.E09.1.454.CMB.2.raw
  modified_base (423)..(423): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgacattgtacttataattctgtctctgtacaacatacccggcaaacgtcccaaactcatgatcttgagtcagtgatcggccgcgtagggttctcatcgcttctccccggctcagtctggcagcaccggccctcctgaccatctcgtgggctcgaggctggaggacgaggctagattatactgcaggtctanaactaataacgaaactaagtaaaccgttacggtttcggggttttaccggaccgggtaccggggaaaccctaaaacggtccggttaaccccgttacccgttaaaccggttacccgaaccgttaaccccgaaacgggttaccccgtccccggtaccccccgttccggggttaccctaaccccgtttccggttccccggtttccccccgttcccccccg

SEQ ID NO: 365709 - DNA, 536 bp, Homo sapiens
  misc_feature: GZ8MTXP01DIK5C.51.53.E09.1.454.CMB.2.raw
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacattggtacttataattctgtctctgtacaacaatacccgcaaagtcccaaactcatgatcttgagtcagtgatcggcccgcaggggtttctcatcgcttctcccggctcaagtctggcagcacggcctccctgaccatctctggctccaggctgagacgaggctgattatactgcaggctcaatataacaaaacagaaacaacttggggtgttcgggcggacggggaaccaaacgttcgacccgttcgtaacgtcgaacgcccaaagggcctcgccccctgggccttactcgttcgttcccccg

SEQ ID NO: 365710 - DNA, 534 bp, Homo sapiens
  misc_feature: GZ8MTXP01BM6HH.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccccggctcaagtctggcagcacggcctccctgaccatctctgggctccaggctggaggtacgaggctgattattactgcaggctcatatacaaacagaaacacgttgggtagttcgggcggcgggtaaccaaacgttcgaccgttcctacgtcacgcccaggctcgccccctggtcactcgcgttccccc

SEQ ID NO: 365711 - DNA, 566 bp, Homo sapiens
  misc_feature: GZ8MTXP01AO85J.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggacaaacgtcccaaactcatgatcttgagtcagtgatcggccgcgaggggtttctcatcgcttctccccggctcaagtctggcagcacgcctccctgaccatctctgggctccgaggctggaggacgaggctgattatactgcaggctacatataacaaacaagaaacacgttgggtcgttcgggccgggtcggggaaaccctaaacgttcggacccgttccgtaacggtcacgcccgaaggcccttacggcccccgttcgggtccaccctcgttccgttaacccccc

SEQ ID NO: 365712 - DNA, 543 bp, Homo sapiens
  misc_feature: GZ8MTXP01DRV9B.51.53.E09.1.454.CMB.2.raw
  modified_base (415)..(415): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattgtacttataattctgtctctgtacaacaatacccgcaagtacccaactcatgatcttgagtcagtgatcggcccgcgtaggggttctcatcgctctcccgctcagtctgcagcacgccctccctgaccatctctcgggctccaggctgaggacgaggctgattagtactgcagctanatataacaaacagaaactacgttgggtcgttcggcgggccgggaaccaaacgttcgaacccgttccgtacgtcacgttcccgaacggccttccgccccgttcggtccttacctccgttcgttcccccg

SEQ ID NO: 365713 - DNA, 576 bp, Homo sapiens
  misc_feature: GZ8MTXP01C2J58.51.53.E09.1.454.CMB.2.raw
  modified_base (384)..(384): a, c, t, g, unknown or other
  modified_base (387)..(387): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgactattggtacttataattctgtctctgtaccaacaatacccgacaaacgtcccaaactcatgatcttgagtcagtgatcggcccgtgtacgggttctacatcgtcttcgtccccggctcaagtctggcagcacgcctccctgaccatcncgnggctccgaggctggaggacgaggtctagattatactgacaggctacaataactaaacaaacaagaaactacggttgggtcgttccgggcgggccgggaaccaaacgttcggtacccgttccgttaacgcaccggcccaacgggtccctccgtcccccgtcggtccaccgttcccttccgttaacccccc

SEQ ID NO: 365714 - DNA, 568 bp, Homo sapiens
  misc_feature: GZ8MTXP01DLFVG.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctggtaccaacaataccccggcaaagtccccaaactcatgatctttgagtcagtgatcggccgcaggggtttctcatcgcttctcccggctcaagtctggcagcacggcctccctgaccatctctgggctccgaggctgaggacgaggctgattattactgcagctcataataacaaacgagaaactacgttgggtgttcgggcggcggggaacctaaaacgttcgtaacccgttccgtaacggtccaacggccccaaagggtccctcggccccccttcgggtccttaccgttccttccgtttaacccccc

SEQ ID NO: 365715 - DNA, 537 bp, Homo sapiens
  misc_feature: GZ8MTXP01CACDF.51.53.E09.1.454.CMB.2.raw
  modified_base (410)..(410): a, c, t, g, unknown or other
  modified_base (428)..(428): a, c, t, g, unknown or other
  modified_base (435)..(435): a, c, t, g, unknown or other
  modified_base (447)..(447): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaacgtccccaaactcatgatctttgaggtcagtgatcggcccgcagggggtttctcatcgcttctcccggctcaagtctggcagcacggccctccctgaccatctcgtgggctccgaggctggagacgnggctgattagtactgacncggctanatactaacaaanacgaaactacgtagggtgttcggcggcggaaccaaagttcgaccgttcgacgtcacgcccagcctcgcccctcggcactcgttcgtcccc

SEQ ID NO: 365716 - DNA, 566 bp, Homo sapiens
  misc_feature: GZ8MTXP01BZXT0.51.53.E09.1.454.CMB.2.raw
  modified_base (434)..(434): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgactattgtacttataattctgtctctgtaccaacaactaccccgacaaacgtccccaaactcatgatcttgagtcagtgatcggcccgcgtaggggtttctcactcgtcttctccccggctcaagtctgacacgcgacggccctccctcgaccatctcgtgggcctccgaggctaggacggacgaggctgattatacgtncagctacaataactaacaaacgagaaactacgttgggtcgttcgggcggacgggaaccaaacgttcggaccgttccgtacgcacgcccaacggtctccgcccctcggtccacgttccgttccgttaaccccc

SEQ ID NO: 365717 - DNA, 610 bp, Homo sapiens
  misc_feature: GZ8MTXP01AXOR3.51.53.E09.1.454.CMB.2.raw
  modified_base (336)..(336): a, c, t, g, unknown or other
  modified_base (435)..(435): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattgtacttataattctgtctctgtaccaacaataccccggcaaacgtccccaaactcatgattctttgaggtcagtgatcggcccgcgtaggggtttcnctatcgcttctcccggctcaagtctggcagcacggccctccctcgaccatctcgtcgggctccgaggctgaggtacgagctgattatactgcaggtctnaatactaaacaaacaacgaaactacggtttggggtacggtttccggggaccggggaccggggtaaaccccaaacgttccggaacccgttaccgtaccggtaccaccggacccgaaaccgggtctacccgggtcccccttcgggtcccttaccttccgttcccggtttcccccccc

SEQ ID NO: 365718 - DNA, 570 bp, Homo sapiens
  misc_feature: GZ8MTXP01DOB3O.51.53.E09.1.454.CMB.2.raw
  modified_base (331)..(331): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtacaacaataccccggacaaagtcccaaatcatgatctttgaggtcagtgatcggccgctaggggtttcncatcgcttctcccggctcaagtctggcagcacgccctccctgaccatctctggctccaggctgaggacgaggctgattatactgcaggctatataactaacaaaacagaaaactacgttgggtggttcggcggacggggaaacctaaacgttacggacccgttccgtaccgtcacggcccgaaacggtcccttaccgccccccgttcgggtaccttaccgtccttccggtttccccccc

SEQ ID NO: 365719 - DNA, 516 bp, Homo sapiens
  misc_feature: GZ8MTXP01BDS0K.51.53.E09.1.454.CMB.2.raw
  modified_base (329)..(329): a, c, t, g, unknown or other
  modified_base (384)..(384): a, c, t, g, unknown or other
  modified_base (401)..(401): a, c, t, g, unknown or other
  modified_base (406)..(406): a, c, t, g, unknown or other
  modified_base (411)..(411): a, c, t, g, unknown or other
  modified_base (413)..(413): a, c, t, g, unknown or other
  modified_base (421)..(421): a, c, t, g, unknown or other
  modified_base (490)..(490): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccacaatgactattggtacttataattctgtctctggtaccaacatacccggcaaagtcccaaatcatgatcttgagtcagtgatcggcccgcgtagggtttcnctatcgcttcgtcccgctacgaagtctggcagcgacgcctccctgaccatctcgnggctccagctgagacgngctanatatntncacgctanatacaacaacagaactcgtggtcgtacggcgacggaacaacgcgtaccgcgtacgcacgccgacgtccnccgtccctcgtcacctcttccgtccc

SEQ ID NO: 365720 - DNA, 559 bp, Homo sapiens
  misc_feature: GZ8MTXP01AWF34.51.53.E09.1.454.CMB.2.raw
  modified_base (327)..(327): a, c, t, g, unknown or other
  modified_base (524)..(524): a, c, t, g, unknown or other
  modified_base (540)..(540): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtacacatacccggcaacgtcccaactcatgatcttgagtcagtgatcggcccgcgtaggggtttcncatcgcttctcccggctcaagtctgcagcacggccctccctcgacctatcctcgtcgggcctccgagggcctggaggaccggaggctgattatactgcaggctcatactaacaaacagaaactacgttgggtcggttcggccgggtcgggaacccaaacgttcggaacccgttccgtacgtcacgcccgaaggtccncgtccccctggtaccnccgtccgttcgttcccccg

SEQ ID NO: 365721 - DNA, 606 bp, Homo sapiens
  misc_feature: GZ8MTXP01C4L8W.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattgtacttataattctgtctctggtaccaacaataccccgacaaacgtacccaaactcatgatctttgagtcagtgagtcggcccgcgtagggggtttctcatccgtcttccgtccccggctaccaagtccgtggccagccgaccggtccctccctcgacccatctcgtcgggctccgaggctagacggacgaggctagtattattactagcaggtctataataactaaacaaaactaacgtaaacgtaacgttgggtacggttcggccgggtccggaaacctaacgttcgacccgttccgtaacgtcaccggttcccaaggtcctccgcccccgttcggaccttaccttccgttcccgtttaaccccc

SEQ ID NO: 365722 - DNA, 579 bp, Homo sapiens
  misc_feature: GZ8MTXP01CFZ8C.51.53.E09.1.454.CMB.2.raw
  modified_base (434)..(434): a, c, t, g, unknown or other
  modified_base (444)..(444): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacattgtacttataattctgtctctggtaccaacaactaccccggacaaacgtccccaaactcatgatctttgaggtcagtgagtccggcccgcgtaggggtttctcatcgcttctccccggctcaagtctggcagcacgccctccctcgaccatctccgtcgggcctccgaggctggagggacgaggctagattattacngcaggcttanaataactaacaaaacagaaactacgttggggtgttccgggacgggaccgggaacctaaacgttcgtaccgttccgtacggtcacgttccaacggtcctaccgccccgtcgtccttaccgtccttcccgttccccc

SEQ ID NO: 365723 - DNA, 538 bp, Homo sapiens
  misc_feature: GZ8MTXP01DO4HI.51.53.E09.1.454.CMB.2.raw
  modified_base (376)..(376): a, c, t, g, unknown or other
  modified_base (382)..(382): a, c, t, g, unknown or other
  modified_base (414)..(414): a, c, t, g, unknown or other
  modified_base (421)..(421): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtaccaacaataccccggcaaagtccccaaactcatgatcttgagtcagtgatcggcccgcgaggggttctcatcgcttctcccggctcaagtctgcagcgacgcctccctgaccntctcgnggctcaggctagaggacgagctgattatactncagctanatactaacaaacagaaactacgttgggtgttacggcgggcgggaaccaacgttcgacccgttcgtaacgtcacgcccgaagtcctaccggcccctcggcacctccgttcgttccccc

SEQ ID NO: 365724 - DNA, 546 bp, Homo sapiens
  misc_feature: GZ8MTXP01AZIHT.51.53.E09.1.454.CMB.2.raw
  modified_base (510)..(510): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtacaacatacccgcaaagcccaactcatgatcttgagtcagtgatcggcccgcagggggtttctcatcgtcttctcccggctcaagtctgcagcacggccctccctgaccatctctcgggctccgaggctggaggacgaggctgattatactgcaggctcatactaacaaacagaaactacgttgggtacgttcgggcgggcgggaaccaaacgttcgacccgttccgtacgtcacgcccgaacggtccnccgcccctcggtccttacctccgttcgttaaccccc

SEQ ID NO: 365725 - DNA, 571 bp, Homo sapiens
  misc_feature: GZ8MTXP01DK91H.51.53.E09.1.454.CMB.2.raw
  modified_base (442)..(442): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattgtacttatattctgtctctgtaccaacaactaccccggacaaacgtaccccaaactcatgatctttgagtcagtgatccggccgcgtaggggttctcatcgtcttccgtccccgctcaagtctggacagccacggccctccctcgaccatctcgtggcctccgaggctggaggacgagtctagtattatacgtgcaaggctanaataactaaacaaacagaaactagttggtcgtcgggccggacggaaccaaagttcgtaccgccgtacgtcgacgcccgaggtccctaccgtcccccgtcggtcccttacctccgttccgttaacccccc

SEQ ID NO: 365726 - DNA, 542 bp, Homo sapiens
  misc_feature: GZ8MTXP01BHWHQ.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcagggggtttctcatcgcttctccccggctccaagtctggcagcacggccctccctgaccatctctgggctccaggctgaggacgaggctgattatactgcaggctcatataacaaacagaaacacgttgggtagttcggcggcgggaaccaaacgttgaccgttcctacgtcacgttcccaaggcctcgcccctcggtccactccgttcgttcccccg

SEQ ID NO: 365727 - DNA, 563 bp, Homo sapiens
  misc_feature: GZ8MTXP01DFRCX.51.53.E09.1.454.CMB.2.raw
  modified_base (315)..(315): a, c, t, g, unknown or other
  modified_base (350)..(350): a, c, t, g, unknown or other
  modified_base (419)..(419): a, c, t, g, unknown or other
  modified_base (424)..(424): a, c, t, g, unknown or other
  modified_base (431)..(431): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattgtacttatattctgtctctgtacaacaatacccgacaaacgtacccaaactcatgatcttgagtcagtgatcggccgngtagggttctcatcgcttctccccggctcaagtcnggcagccacggccctcccgtcgaccatctacgtcgggactccgagcgtgaggacgaggctgattatacngtacnggtctanataactaacaaacaagaaacgtacgttgggtcgttcgggcggacgggaaccaacttcggtacccttcgtacgtcacgttcccaacggtcctcccgtccccgttacggccttacgttccgttccgttcccccg

SEQ ID NO: 365728 - DNA, 559 bp, Homo sapiens
  misc_feature: GZ8MTXP01BMAVZ.51.53.E09.1.454.CMB.2.raw
  modified_base (540)..(540): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaacgtccccaaactcatgatctttgagtcagtgatcggcccgcgtaggggtttctcactcgcttctccccggctccaagtcctggcagccaccggccctcccgtcgaccatctcgtcgggcctccgaggctggaggacgaggctgattatactgcaggctcatactaacaaacagaaactacgttgggtacggttcgggcggtacgggaacctaaacgttcgacccgttcgtacgtcacgcccaagggcctcgccccgnggtccactcgttcgtcccc

SEQ ID NO: 365729 - DNA, 623 bp, Homo sapiens
  misc_feature: GZ8MTXP01DAK29.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgactattggtacttataattctgtctctgtaccaacaactacccgacaaacgtacccaaactcatgattcttgagtcagtgagtcggcccgcgtagggttctcatcgtcttcctccccggctcaagtctggcacgcaccggccctccctcgaccactctcgtcgggcctccgagggctggaacggacgaggtctagtatttattacgtgcaggtctactaataactaaaccaaaacgaagtaaaaccgttacggtttggggtacggttccggggaccggggtaccggggaaacctaaacgttcggacccgttccgtaaccgtcgaaccgcccgaacgggcccttacccgcccccgtcggtaccttaccgttcccgttccggtttccccccg

SEQ ID NO: 365730 - DNA, 545 bp, Homo sapiens
  misc_feature: GZ8MTXP01BCTEI.51.53.E09.1.454.CMB.2.raw
  modified_base (322)..(322): a, c, t, g, unknown or other
  modified_base (332)..(332): a, c, t, g, unknown or other
  modified_base (516)..(516): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccacaatgactattggtacttataattctgtctctggtaccaacaactaccccggcaaacgtcccaaactcatgatcttgaggtcagtgatcggcccgngagggtttcncatcgcttctcccggctcaagtctggcagcacggccctccctgaccatctcgtcgggctccgaggctggacggacgagtctagattacttactgcaggctacaataactaaacaaacaagaaacctagttgggtcgttcggcgggcgggaacaaacgttgaccgttcgtacgcacgcccacgcncgccccgtgtccaccgtcgttcgtccccg

SEQ ID NO: 365731 - DNA, 552 bp, Homo sapiens
  misc_feature: GZ8MTXP01DF98U.51.53.E09.1.454.CMB.2.raw
  modified_base (329)..(329): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccaccaatgacattggtacttataattctgtctctgtacaacatacccgcaaagtcccaaactcatgatctttgagtcagtgatcggcccgctaggggttctnactcgcttctcccggctcagtctggcagcacggcctccctgaccatctctgggctcaggctgaggacgaggctgattattatgcagctcaatactacaaacaagaaactacgttgggtagttcgggcggcgggaaaccaaacgttcggtacccgttaccgttaccgcacggcccaaacgggcctccgtccccctggtccttaccgtccttcggttaacccccc

SEQ ID NO: 365732 - DNA, 569 bp, Homo sapiens
  misc_feature: GZ8MTXP01C7F3Q.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccgacaaacgtcccaaactcatgatctttgagtcagtgatcggcccgctaggggtttctcatcgcttctcccggctccagtctggcagcaccggccctccctgacccatctctgggctccgagctgagacgaggctgattatactgcagctcataatacaaaacagaaacacttgggtagttcgggcggtccggggaacctaaacgcggtacccgttccgtaaacgtccgacgccccaaagggtcctccgccccccgttcgggtacccaccctttccgttccggtttccccccc

SEQ ID NO: 365733 - DNA, 590 bp, Homo sapiens
  misc_feature: GZ8MTXP01BNAQO.51.53.E09.1.454.CMB.2.raw
  modified_base (432)..(432): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgacattggtacttataattctgtctctgtaccaacaactacccgacaaacgtcccaaactcatgatcttgagtcagtgatcggcccgcgtaggggtttctcatcgcttcgtccccggctcagtctggcagcgacgccctccctgacctatctcgtggcctcgaggctgaggacgaggtctgattatactgtcaggctanaataactaaacaaacgagaaactacgtttagggtggttaccgggccgggaaccggggaacctaaacgttcggtacccgttaccgtaaccggtacaccgcccgaacggtcctcccgtaacccccgttcggtaccttaccgtccgttcccgttccccccg

SEQ ID NO: 365734 - DNA, 646 bp, Homo sapiens
  misc_feature: GZ8MTXP01AJHNR.51.53.E09.1.454.CMB.2.raw
  modified_base (322)..(322): a, c, t, g, unknown or other
  modified_base (333)..(333): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattgtacttataattctgtctcctggtaccaacactaccccggcaaacgtccccaaactcatgatcttgagtcagtgatcggccgngaggggtttcncatcgcttctccccggctcaagtctggacacgcacggccctccctgaccctatcctcgtcgggcctccgagggctggagggacgaggtcgtagtattacttacgtgacaggtctactaactaactaaaccaaaacgacgaaaaccgttacggttcggggtggttaccggggaccggggaccggggtaaacccaaacgttccggaacccgttaccgttaaccggtaccgaccgaccccggaacgggtccccgttcccgggtcccccccgttcgggtaacccttacccgtttcccgttcccggtttccccccccg

SEQ ID NO: 365735 - DNA, 676 bp, Homo sapiens
  misc_feature: GZ8MTXP01CQDB2.51.53.E09.1.454.CMB.2.raw
  modified_base (309)..(309): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactacgaaccacaatgactattgtacttatattctgtctctgtaccaacaactaccccggacaaacgtacccaaactcatgatcttgagtnagtgactcggccgtcgtaggggttctcactcgtcttcgtccccggtctacgaagtcgtggacacgccgaccggtccctacccgtacgacctactctcgtcgggtcctaccgaggcgtacggaacgggacggtaacgggtcctaggtaatttaacttaacgtcggtactacggtacttaacctaaataactaaaccgaaaacaacgtaaacgtaccggttgggtacggttaccgggaccgggaccgggtaaacccgtaaaccgttacggtaacccgttacccgttaacggtaccgaccgacccgaaacgggtcccctacccggtcccccgttcggtacccttaccgttcccgtttcccgttccccccg

SEQ ID NO: 365736 - DNA, 535 bp, Homo sapiens
  misc_feature: GZ8MTXP01BDH0R.51.53.E09.1.454.CMB.2.raw
  modified_base (322)..(322): a, c, t, g, unknown or other
  modified_base (332)..(332): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctggtaccaacaataccccggcaaacgtccccaaactcatgatcttgaggtcagtgatcggcccgnaggggtttcncatcgcttctccccggctcaagtctggcagcacggccctccctgaccatctctgggctccgaggctgaggacgaggctgattagtactgcaggctcatataacaaacagaaacacgttgggtacgttcggacggcgggaacaaacgttcgaccgttcctacgtcagcccaggcctgcccccttggtccactcgttcgtccccg

SEQ ID NO: 365737 - DNA, 597 bp, Homo sapiens
  misc_feature: GZ8MTXP01C9CAK.51.53.E09.1.454.CMB.2.raw
  modified_base (387)..(387): a, c, t, g, unknown or other
  modified_base (412)..(412): a, c, t, g, unknown or other
  modified_base (427)..(427): a, c, t, g, unknown or other
  modified_base (437)..(437): a, c, t, g, unknown or other
tcagcgatcgtatacacgaccggtgctcgatttagagagagtgtgttggggtttgggggggtctcaggaggcagcgctctcgggacgtctccaccatggcctgggctgtgctattcctcaccctcctcactcagggcacagggtcctgggcccagtctgccctgactcagcctgcctccgtgtctgggtctcctggacagtcgatcaccatctcctgcactggaaaccaccaatgacattggtacttataattctgtctctggtaccaaacaataccccggacaaacgtaccccaaatcatgatctttgagtcagtgatcggcccgcgtagggttctcatcgcttctccccgctcagtctggacagccacgccctccctgaccatcnctgggctccgagggctggaggacgnggctgattattacgngacagtctanaataacaaacaaacgaacgtaaacgtacggttgggtcggtacgggccgggtaaccggaaaccctaaacgttccggtacccgttaccgtacgtcgaaccggcccgaacggtcccgtccccgtcccccgttcggtcccttacccttccgttccccgttcccc

SEQ ID NO: 365738 - DNA, 536 bp, Homo sapiens
  misc_feature: GZ8MTXP01D2N0O.51.53.E09.1.454.CMB.2.raw
  modified_base (434)..(434): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattgtacttataattctgtctctggtaccaacaatacccggcaaagtcccaaactcatgatctttgagtcagtgatcggcccgcagggggtttctcatcgcttctcccggctcaagtctggcagcacggcctccctgaccatctctgggctccaggctgaggacgaggctgattatactagcaggctcatataacaaanacgaaactaacgtgggttgttcggcggcggaacctaaacttgacccgttcctacggtcacgcccaaggcctcgcccctcggtccacgtcttcgttaaccccc

SEQ ID NO: 365739 - DNA, 538 bp, Homo sapiens
  misc_feature: GZ8MTXP01BTZEV.51.53.E09.1.454.CMB.2.raw
  modified_base (414)..(414): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgaatcagcctgcctccgtgtctgggtctcctggacagtcgatcaccatctcctgcactggaaccacaatgacattgtacttataattctgtctctgtaccaacaatacccggcaaagtcccaaactcatgatcttgagtcagtgatcggcccgcgtaggggtttctcatcgcttctcccggctcaagtctggcagcacggccctccctgaccatctcgtgggctccgaggctgagacgagctgattatacngtcaggctacatactaacaaacagaaactacgttgggtgttcgggcggcgggaaccaaacgttcgacccgttcgtacgtcgaacgccgaaggctcgcccctcggtccacgtcttcggttccccc

SEQ ID NO: 365740 - DNA, 540 bp, Homo sapiens
  misc_feature: GZ8MTXP01DVOCE.51.53.E09.1.454.CMB.2.raw
  modified_base (408)..(408): a, c, t, g, unknown or other
  modified_base (410)..(410): a, c, t, g, unknown or other
  modified_base (417)..(417): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggacttataattctgtctctggtaccaacaatacccggcaaagtaccccaaactcatgatctttgaggtcagtgatcggcccgcagggggtttctcatcgcttctccccggctaccaagtctggcagcacgcctccctgaccatctctgggctccaggctgagacgaggntnatatatncagctctaataataaacaaacaaagaaactaacgtggtggtcggcgggcggaaccgaaacgacgtaccgttaccgtacgtacacgccgacgctccgtcccgtccgtcttacctcgttcgtccc

SEQ ID NO: 365741 - DNA, 585 bp, Homo sapiens
  misc_feature: GZ8MTXP01D6RGG.51.53.E09.1.454.CMB.2.raw
  modified_base (430)..(430): a, c, t, g, unknown or other
  modified_base (434)..(434): a, c, t, g, unknown or other
  modified_base (441)..(441): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaaccacaatgactattgtacttataattctgtctctagtaccaacaactaccccgacaaacgtccccaaatcatgatctttgagtcagtgatccggccgcgtagggtttctcatcgcttctccccggctacgaagtctggacagcaccgcctccctgaccatctcgtcgggctcgaggctggaacggacgaggctagtattatacngacnggtctanaataactaaacgaaaacagtaaaactaggttggggtcgtcgggaccgggacggaaacctaacgttcggtaacccgttccgtacgtacgaccgaccgacggtccctccggcccctcggtcttaccgttccttcccgttaaccccc

SEQ ID NO: 365742 - DNA, 679 bp, Homo sapiens
  misc_feature: GZ8MTXP01BTCZD.51.53.E09.1.454.CMB.2.raw
  modified_base (323)..(323): a, c, t, g, unknown or other
  modified_base (335)..(335): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgactattgtacttataattctgtctctgtaccaacactacccggacaaacgtccccaaatcatgatctttgagtcagtgatcggcccgngtaggggtttcnctatcgcttcgcccggctcagtctggacagccacggccctcccgtcgacctactcgtcgtcgggtctccgaggcgtaggacgggaaccgagtcttagtattacgttacaggacacgggtctaactaacttaaactaaaccgaaaactaacgaaaaccgttacggtttacgggggtacggtttccggggaccgggtacccgggggtaaaccctaaacggttaccggtaccccggttacccgttaacccgggtacgttacccggaccccgaaacggggtccccctacccgggttcccccgttccggggtacccttacccgtttccgttccccggtttccccccccg

SEQ ID NO: 365743 - DNA, 614 bp, Homo sapiens
  misc_feature: GZ8MTXP01BFESL.51.53.E09.1.454.CMB.2.raw
  modified_base (336)..(336): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattgtacttatattctgtctctggtaccaacaactaccccggacaaacgtccccaaactcatgatcttgaggtcagtgactcggccgcgtaggggtttcnctatcgcttctcccggctcaagtctggcacgcacgggccctccctcgacctactctcgtcgggctccgagggtctaggaggacgagggaccttggattactagtgcgaggctcaactaactaaacaaacagaaacctacggtttgggtacggttccgggacgggtccgggaaaccgtaaacgttcggtaacccggttcccgtaacggtcgaaccgacccgaacggccctccgaacccccgttccggtacccttaccgttccgttcccgtttaaccccc

SEQ ID NO: 365744 - DNA, 580 bp, Homo sapiens
  misc_feature: GZ8MTXP01D0BH3.51.53.E09.1.454.CMB.2.raw
  modified_base (432)..(432): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgacattgtacttataattctgtctctgtaccaacaataccccggcaaacgtcccaaactcatgatctttgagtcagtgatccggcccgcgtagggggtttctcatcgcttcctcccggctcaagtctggcagcacggccctccctcgaccatctctcggctccgagctggaggacgaggctgattatactgcaggtctanaataactaacaaacagaaactacgttgggtcgttcgggccggcgggaacctaaacgttcgtaacccgttccgtaaccgtccgacggcccgaaacggtcccgtacccgtcccccgttacggtccacccttccgttccggtttccccccg

SEQ ID NO: 365745 - DNA, 599 bp, Homo sapiens
  misc_feature: GZ8MTXP01CEPHM.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaactaccccggacaaacgtaccccaaactcatgatcttgaggtcagtgatcggcccgcgtagggtttctcatcgcttctccccggctcaagtctggcagcacgccctccctcgaccatctcgtcggctccgaggcgtgacggtacgaggtctcgtattacgtaactgactaggtctactaataactaaacaaactaacgaaactacggttgggtcggttcgggcggaccggtaaccaaacgttcgtacccggttccgtaaccgtcaccgttcccaacggtcccgtaccgtcccccgtcggtccttacctcccgttccgtttaacccccc

SEQ ID NO: 365746 - DNA, 620 bp, Homo sapiens
  misc_feature: GZ8MTXP01BGVI2.51.53.E09.1.454.CMB.2.raw
  modified_base (447)..(447): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgactattgtacttataattctgtctctgtaccaacaactaccccggacaaacgtcccaaactcatgatctttgagtcagtgatcggcccgcgtaggggtttctcatcgcttcctcccccggctaccgaagtcgtcggacacgccgaccggccctccctacgaccactctcgtcggctccgaggctggaggacgagctgattatactgcaggctanaataactaaacaaacaacgaaactacggtttgggtcggttaccgggacgggtaccggaaacccgtaaacgttccggtaacccgttaccgtaaccgtccgaccggccccgaacggtcccgtccccgtcccccgtccgggtaccttacccgttccgttccccggtttcccccccg

SEQ ID NO: 365747 - DNA, 787 bp, Homo sapiens
  misc_feature: GZ8MTXP01E3FEL.51.53.E09.1.454.CMB.2.raw
  modified_base (305)..(305): a, c, t, g, unknown or other
  modified_base (343)..(343): a, c, t, g, unknown or other
  modified_base (497)..(497): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcgaaaccacaatgactagttgtacttatattctgtctctgtaccaacaactaccccggacaaacgtaccccaaactcatgatntttgaggtcagtgactccgggcccgtcgtagggtttcncagtcgtcttccgtccccggcctacaagtcctggaccacgtccgaccgggtcccctacccgtcgacccctacttccgtccgttacggggtcccttacccggaagggtcgtagggaacgggaacgacggggtcttaggtaactttaattaaccgnggacctaacgggtcctaactaaacttaaactaaaaccaaaaacgtaaccggtaaaacgtttacccggggtttaggggttaccggggtttacccgggggaccggggtaaacccggggaaaacccgtaaaaccggtttcccgggtaaaccccgggttacccgtttaaaccggggtcccaaacccggggttaaccccgttaaacccgggtccccgtacccccggttcccccccggttttacggggccccgttaaccctttccccggggtttccccgttttaaccccccccccg

SEQ ID NO: 365748 - DNA, 687 bp, Homo sapiens
  misc_feature: GZ8MTXP01AYXPJ.51.53.E09.1.454.CMB.2.raw
  modified_base (338)..(338): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctggtaccaacaactaccccggcaaacgtccccaaactcatgatcttgaggtcagtgatcggcccgtcgaggggtttcncatcgcttctccccggctcaagtctgcagcgacgcctccctcgaccatctcgtcgggcctccgaggtctaggaggaccggagggtcctaggtaactttacttaacgtggtaccgaagtcctactaactaaacgttaaaccaaaaacgaacgtaaaaccgtaccgggtttggggttacgggtttaccggggaccggggtacccgggaaaacccgtaaaccgttacgggtaacccccgttaccgtttaacccggtacccgaaccggttcccccgaaacggggtcccctcccggtcccccccggttcgggtccccgttaaccttcccgtttccccggtttaaccccccccgg

SEQ ID NO: 365749 - DNA, 589 bp, Homo sapiens
  misc_feature: GZ8MTXP01DG0QM.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtaccaacaactacccggacaaacgtcccaaactcatgatcttgagtcagtgatcggccgcgtagggttctcatcgcttcctcccgctcagtctgcagcacgccctccctgaccatctctggctccaggctgaggacgaggctgattatactgcaggtctacataactaacaaaacagtaaacctagtttggggtggtttccggggacggccggggtaaacaaacgttcggtaacccgttaccgttaaccgtcgaacggcccccgaaaggtccccgttaccggtccccccgttacgggtcccttaccgttccgttcccgtttcccccccg

SEQ ID NO: 365750 - DNA, 598 bp, Homo sapiens
  misc_feature: GZ8MTXP01BT88R.51.53.E09.1.454.CMB.2.raw
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccacaatgactattgtacttataattctgtctctggtaccaacaactacccggacaaacgtccccaaatcatgatcttgagtcagtgatccggccgcgtaggggtttctcatcgcttctccccggctcaagtctggacagcaccggccctccctgaccatctcgtcgggctccgaggctaggaggacggagtctagtattactacgtgcaggtctacaataactaaacaaacgaacgtaaactacggttcggggtcgttccggggaccgggaccgggaaacctaaacgttcggaacccgttccgtaccgtcgacgcccgaacgggcctcccgaaccccgttcggtaccttaccgttccttcccgttaaccccc

SEQ ID NO: 365751 - DNA, 532 bp, Homo sapiens
  misc_feature: GZ8MTXP01E00Y7.51.53.E09.1.454.CMB.2.raw
  modified_base (336)..(336): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcactggaaccaccaatgacattggtacttataattctgtctctggtaccaacaatacccccggcaaacgtccccaaactcatgatctttgaggtcagtgatcggccccgcagggggtttcncatcgcttctccccggctcaagtctggcagcacggcctccctgaccatctctgggctccaggctgaggacgaggctgattatactgcaggctcatataacaaacagaaactacgtgggtgtcggcggcgggaaccaaacttgacccgttctacgtcacgcccaaggctcgccccctcggtcacctcttcgtccccc

SEQ ID NO: 365752 - DNA, 801 bp, Homo sapiens
  misc_feature: GZ8MTXP01ESTRP.51.53.E09.1.454.CMB.2.raw
  modified_base (278)..(278): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgaaccacaatgactattgtacttatattctgtctctgtaaccaacaactaccccgganaaacgtccccaaactcatgtattcgttgagtcagtgagtccggccgtcgtaggggtttctgatcgtccttcgtccccggcctaccgtaagtcctacggaccacggcccgacccgggtccccttccccgtacgtaacccctacgtcccttccggtccgggggtaccttaccggaacgggtccggttagggaacggggtaaccgggtaacggggtcctttagggtaaactttaacgtttaacgtcgtaccgtaacggggtccttaaacgtaaacttaaacctaaaaccggaaaaaacctaaacggtaaaaaccggttaaccgggttttggggggttaccgggtttacccgggggaccggggtaacccggggaaaacccctaaaaccgggttccggtaacccccggttaaccgttacccggtaacccggaaaccgttaccccgggaaacgggttccccgttccccggtaacccccgttcccggggtaccttacccgtttaacccgtttccccggtttaaccccccc

SEQ ID NO: 365753 - DNA, 572 bp, Homo sapiens
  misc_feature: GZ8MTXP01DYV4K.51.53.E09.1.454.CMB.2.raw
  modified_base (315)..(315): a, c, t, g, unknown or other
  modified_base (338)..(338): a, c, t, g, unknown or other
  modified_base (386)..(386): a, c, t, g, unknown or other
  modified_base (391)..(391): a, c, t, g, unknown or other
  modified_base (406)..(406): a, c, t, g, unknown or other
  modified_base (463)..(463): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtgaaccacaatgactattgtacttatattctgtctctgtaccaaacaactacccgacaaacgtacccaaactcatgatctttaggagtcaggtnacgtccggccgcgtagggtttcnctactcgtctctccccggctacgagtctggacacgccacggcctcccncaccntcgtctcgggctcgnggctaggacggacgaggctagtattaagtcagacacgtctacaataactaaacaaanacgaaactacggttgggtacgtcggacggacggtaaccaaacgttcgaacccgttcgacgtcgacgcccgttagcctccgcccgtacggtcacttccgttccgtccccc

SEQ ID NO: 365754 - DNA, 560 bp, Homo sapiens
  misc_feature: GZ8MTXP01DVT02.51.53.E09.1.454.CMB.2.raw
  modified_base (430)..(430): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgaaccacaatgactattgtacttatattctgtctctgtaccaacaactacccggcaaacgtcccaaatcatgatcttgagtcagtgatcggccgcgtaggggtttctcatcgcttctccccggctcaagtctggcagcacggccctccctgaccatctcgtcgggctcgaggctggaaggacggagtctagtattatactgcaggctanataataacaaacagaactacgttgggtgttcggcggacgggaacctaaacgttcgtaccgttaccgtacgtcacggcccgacgggccctaccgccccgttcggccttaccgttccttccgtttaaccccc

SEQ ID NO: 365755 - DNA, 622 bp, Homo sapiens
  misc_feature: GZ8MTXP01CDS6A.51.53.E09.1.454.CMB.2.raw
  modified_base (332)..(332): a, c, t, g, unknown or other
  modified_base (443)..(443): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactgaaccacaatgacattgtacttataattctgtctcctggtaccaaacaactaccccggacaaaacgtacccccaaaactcaatgtatctttgaggtcagtgactcggcccgngtaggggtttctcatcgtcttcgtcccggctcaagtctggacagcgacgccctcctcgaccatctcgtggcctccgaggctaggacggtacgaggtctagtattattacgngacaggtctactaaataactaaacaaaacgaacgaaacgttaacggttggggttacggttacgggaccgggaccgggtaaaccctaaacgttccggtaacccgttccgtaaccgtcgaccgacccgaacggtccctaccgcccccgttcggtaccttaccgttccttccgttaaccccc

SEQ ID NO: 365756 - DNA, 702 bp, Homo sapiens
  misc_feature: GZ8MTXP01BKNT6.51.53.E09.1.454.CMB.2.raw
  modified_base (313)..(313): a, c, t, g, unknown or other
  modified_base (340)..(340): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactcggaaccaccaatgactagttgtacttataacttctgtctctagaccaaacaactacccgacaaacgtacccaaactcatgatcttgacgtnagtgatccggccgtcgtagggtttctnatcgtcttcgtccccggctacgtaagtcgtggaccacgccgaccggtccctccctcgacctagtcctcgtcgggcctccgaggcgtaggaggtacggaggtctagatttactacgtgctaaggtcttactaataactaaaccgaaaacgtaacgtaaaccgttaacggtttggggttccgggttaccggggacccgggggaaacccgggtaaacccgtaaacggttacccgggtaaccccggttccgttaaacccgggtccaacccggggttacccgttaaaccggggtcccctaccccggtaacccccccggttcggtaccccttaacccggtttcccctttaaccccgggttcccccccc

SEQ ID NO: 365757 - DNA, 656 bp, Homo sapiens
  misc_feature: GZ8MTXP01E3FOD.51.53.E09.1.454.CMB.2.raw
  modified_base (332)..(332): a, c, t, g, unknown or other
  modified_base (342)..(342): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgactattgtacttataattctgtctctggtaccaacaactaccccggacaaacgtcccaaactcatgatcttgagtcagtgatcggcccgcgtaggggttcncatcgcttcnccccggctcaagtctcggcacgccaccggccctccctcgacctactctcgtcgggtcctaccgaggcgtaggacggaacggacgggtactggaatttacttaacgcgacgtacggtactaactaacttaaacgtaaaccaaaacgaaacgtaaacgttacggtttcgggggttacggtacccggggacgggaacccgggtaaacctaaaccggttaccggtacccgttaccgtaaccggtacgacccgttacccgaccggtcccgtcccgtcccccggttccgtaccgttaccgttcccgttcccgttcccccg

SEQ ID NO: 365758 - DNA, 684 bp, Homo sapiens
  misc_feature: GZ8MTXP01EL1RT.51.53.E09.1.454.CMB.2.raw
  modified_base (252)..(252): a, c, t, g, unknown or other
  modified_base (305)..(305): a, c, t, g, unknown or other
  modified_base (318)..(318): a, c, t, g, unknown or other
  modified_base (329)..(329): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgactattgtacttataattcngtctctggtaaccaacaatacccgacaaagtccccaaatcatgatcttgagtnagtgatcggccgngtagggtttcncatcgcttcgtcccggctacaagtctggacagccacggccctccctacgacctatcctcgtcgggctcgacggctggaaggaccggaggtctagtattaacgttactaggactacggggtacttaccaaatttaaacggtaaaacaaaaaccctaaaggttaaaaccgtaaccggtttgggggtaccggtttacgggggaaccggggaaccgggggaaaccctaaaacgttcgggtaaaccccggttacccttaacggtaacccgaacggaccccaaaacggggtcccgtccccggtaaccccccgtttccggggtacccgttaaccttcccgttttcccggtttccccccccgg

SEQ ID NO: 365759 - DNA, 596 bp, Homo sapiens
  misc_feature: GZ8MTXP01BT2DW.51.53.E09.1.454.CMB.2.raw
  modified_base (317)..(317): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccacaatgactattgtacttataattctgtctctgtacaacaatacccgacaaacgtcccaaatcatgatcttgagtcagtgactcggccgngtagggttctcatcgcttctcccgctcaagtctgaacagccacggccctcctcgacctatctcgtcggctcgaggctggacggacgagctagtattatactgactaggctataataactaaacaaacaacgtaaacttacggttggggtcggttcgggaccgggaaccgggtaacctaaaacgttcggtaacccgttccgtaaccgttcgaaccgttcccgaacggtcccttacccgcccccgttgggacccttacgtttccgttcccggtttcccccc

SEQ ID NO: 365760 - DNA, 592 bp, Homo sapiens
  misc_feature: GZ8MTXP01AQLKS.51.53.E09.1.454.CMB.2.raw
  modified_base (336)..(336): a, c, t, g, unknown or other
  modified_base (435)..(435): a, c, t, g, unknown or other
  modified_base (543)..(543): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccaccaatgacattggtacttataattctgtctcctggtacaacaactaccccggcaaacgtcccaaactcatgatctttgaggtcagtgatcggcccgcagggggtttcncatcgtcttcctccccggctcaacgtctcggcacgcaccgggccctccctcgaccctactctccgtaggggccttcccgagggactcggagggaaccgngggtctagtacttattaacgtgccagcttacataactaaacaaacctagaaactacggttggggtcgttcggcgggccgggaacaaacgttcgaccgttccgtacgcncgacccgaggcctccgcccccgtggtccttcttccgttcgttccccccg

SEQ ID NO: 365761 - DNA, 571 bp, Homo sapiens
  misc_feature: GZ8MTXP01EMRHX.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtaccaacaataccccggcaaacgtcccaaactcatgatctttgagtcagtgatcggccgcgtagggtttctcatcgcttctccccggctcaagtctggcagcaccggtcctccctgacctatctcgtgggctccgaggctgaggacgaggctgattatacgtgcaggctcaaattaactaaacaaacaacgtaaacgaccgtttggggtcggttcgggaccgggacgggaaaccaaacgttcgacccgttacgtacgtccacgcccgaaggcctaccgtcccctcggtccacttccgttccgttaaccccc

SEQ ID NO: 365762 - DNA, 775 bp, Homo sapiens
  misc_feature: GZ8MTXP01B3L4Z.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactaggaaccacaatgactattgtacttataattctgtctctaggtaccaaacaactaccccggacaaacgtaccccaaaactcatgtattctttggaggtacagttcgacgtccgggcccgtcgtaggggtttctcgacttcgtcttcctaccccggccttacgtaaacgttcgtgggaccaacgccgaacccgggtcccctacccgttacggaccctaactccgtccgttcgggcccttccgaagggccgttagggaacgggtaaccggagggtacttaggttaaactttaaacgtttaacgcggttcccaaggggtacctttaacctaaatttaaacgtaaaaacctaaaaacccgaaaggttaaaaaacccgttcggggtttttacggggtacggggtttacccggggacccgggggttaaacccggaaacccgaaaaccggtttccgaaaccccggtttacccgaaaccgttaccgaaccgcccggaaaccggtccctaccccggtccccgttccgggtaccttacccgttcccgttaacccgtttaaccccc

SEQ ID NO: 365763 - DNA, 685 bp, Homo sapiens
  misc_feature: GZ8MTXP01AFG6T.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgactagttggtacttataattctgtctctggtaccaacaactacccggcaaacgtcccaaactcatgatcttgagtcagtgagtccggccgcgtagggggtttctcatcgcttccgtccccggtctcaagtctggacacgccacgggccctcctcgaccatctcgtgggctcgaggctaggaggacgaggtcttaggtaacttagttaactcgacgacgggtactactaacttaaactaaaccgaaaacgtaacgtaaaaccgttacggtttacgggggttacggtttaccgggggaccggggtacccggggaaaacccgtaaaaccggttccgggtaaaccccgttacccgttaccggtaccgacccgaccccggttaaacgggtccccgttacccggtccccccgtttacggggtacccttaccggttccctttcccggtttcccccccg

SEQ ID NO: 365764 - DNA, 630 bp, Homo sapiens
  misc_feature: GZ8MTXP01ECDRK.51.53.E09.1.454.CMB.2.raw
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactacgaaccacaatgactattgtacttatattctgtctctgtaccaacaactacccggacaaacgtacccaaatcatagtattcgttagagtcagtgaacgtccgggcccgtacgtaggggtttctactacgtccgcttcctccccggcctacgaagtcgtcggacacgtcgacccggtccctaccctacgaaccgtactcgtcgtcgggcctaccgaggctaggacggtacgaggtctagtacttatactgacaggtctataaattaacaaacaaacaagtaaactacggtttgggtcgtcgggaccggcgggtaaaccaacgttcgtacccgttacgtacgacgaccgttcccgaacggtccctacccgtccccgtacggtcccttaccgtcccgttcggttccccccg

SEQ ID NO: 365765 - DNA, 775 bp, Homo sapiens
  misc_feature: GZ8MTXP01AE29A.51.53.E09.1.454.CMB.2.raw
  modified_base (277)..(277): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccaccaatgactattggtacttatattctgtctctgtacaacaactacccgnaaactcccaatcatgatcttgagtcagtgagtccggccgcgtaggggtttctcgtactccgctttccgtcccccggtacctccgtaaggtccgtagggaccacggccgtacccgggtccccttcccgtcgaaccctcgtccgttccgtcgggggtcccttacccggaggggtcccgtagggaacggtaccgggagggtaccttaggttaactttaactttaacgtcggacctaacggggtcccttaactaaacttaaacgttaaacccaaaaaccgaaacggttaaaaaccgttaccgggtttacggggggttacgggtttaccccgggggtaccgggggaaccccgggtaaacccgtaaaacccggttacgggtaacccccgttcccggtaaaccggtaccccgaaccgttaccccggaaaccgggtcccgtacccggtcccccccgttaaccggggtccccttacccggttcccgtttcccgtttaaccccccccg

SEQ ID NO: 365766 - DNA, 731 bp, Homo sapiens
  misc_feature: GZ8MTXP01CJL9Y.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgacattgtacttatattctgtctctgtaccaacaactacccgacaaacgtacccaaactcatgtatcttgagtcagtagacgtccggcccgtcgtacgggttctactactcgtcttccgtccccggcctacgaagtcgtcggaacacgccgaccggtccctcccgtacgacctactccgtcgtcgggtcctacccgaagggtccgtaggacgggacgtacgggtactcggtaaatttacgttactcgactaacgggcttaactaaacttaacaaaaccgaaaacgaacgtaaaaccgtaacggttttcggggtaacggttcccgggggaaccgggtacccggggaaaacccttaaaccggttccgggttaaaccccgttaccggtttaaacccgtaccgaacccggaaccccggttaaccgggttccccgtccccggttaacccccccgttcgggtaaccccttaccccggtttcccgtttccccggggtttcccccccg

SEQ ID NO: 365767 - DNA, 608 bp, Homo sapiens
  misc_feature: GZ8MTXP01AYGFK.51.53.E09.1.454.CMB.2.raw
  modified_base (449)..(449): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccaccaatgactattgtacttataattctgtctctggtaccaacaactaccccggacaaacgtccccaaactcatgatcttgagtcagtgatccggcccgcgtacgggggtttctctatcgcttccgtccccggctccgaagtctggcacgccacgggccctccctcgaccatctcgtcggctcgaggctggaggtacgagtctgtaattatactgcaggctanaatactaaacaaacgaacgaaacgtaccgttggggtcggttaccgggccgggacgggaaaccctaaacgttccggtaacccgttcccgtaacgtcgaaccggttcccaaacgggtcctcccgcccccgttggtccttaccctcgttccggttccccccg

SEQ ID NO: 365768 - DNA, 645 bp, Homo sapiens
  misc_feature: GZ8MTXP01DIXUZ.51.53.E09.1.454.CMB.2.raw
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctgtaccaacaactaccccggacaaacgtacccaaactcatgattcttgaggtcagtgatccggccgcgtaggggtttctcgactcgtcttcctcccggctacagtctggcagcacacgccctcctcgaccatctcgtggcctcgaggctaggaaggacggaggtctagtattatttaacgcgctaacgtcttaaccaataaactaaaccaaaacaagtaaaaccgtacggttggggtcggttaccggggaccgggtaaccggggtaaacccgaaaccggttaccgggaacccgttacccgtaaccggttccgaaccggttaccccgaacgggtccccgtccggtcccccccgtcgggttccctaaccgttccccgtttccccgg

SEQ ID NO: 365769 - DNA, 693 bp, Homo sapiens
  misc_feature: GZ8MTXP01B1TXI.51.53.E09.1.454.CMB.2.raw
  modified_base (334)..(334): a, c, t, g, unknown or other
  modified_base (375)..(375): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgactattgtacttatattctgtctctgtacaacactacccgacaaacgtcccaaactcatgatctttgacgtcagtgacgtccggccgcgtacggggtttccncgtactcgtcttcctcccccggctaccaagtccgtggaccncgccgaccggtccctcccgtcgacctatccgtcgtcgggcctccgaggcgtagggacggacggacggtctagtaattacgttacgtcgaccgtagtactactaattaaactaaaaccaaaacgtaacggtaaaccttacgggtttacggggtacgggttacccggggaccgggtaacccggggtaaaccctaaaccgttcggtaaccccggttaccgtacccggttaaccgacccggttaccccgttaacgggtccccgtcccggtccccccgtttacgggtcccttaacccggttcccttaacccgtttaacccccc

SEQ ID NO: 365770 - DNA, 652 bp, Homo sapiens
  misc_feature: GZ8MTXP01CRYLI.51.53.E09.1.454.CMB.2.raw
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgactattgtacttatattctgtctctgtacaacaactacccgacaacgtacccaactcatgatcttgagtcagtgatcggccgtcgtaggggtttctcactccgtcttccgtcccccggtcctaccgtaagtccgtcggacacgccgaccgggtcccctcccgtcgacctactcgtcgtcgggctccggaggtcgtaggacggacgaggctagtaattacttacgtagccaggtccttacaaattaacaaaccgaaaccaaaggtaaacctacgggtttcgggtacggttaccgggaccgggaacggtaaacccgtaaacgttccggtaacccgttaccgtaaccggtcaaccggttcccgaacggtcccgtcccgtcccccgttcggtaccttccgttcccgttccgtttccccccg

SEQ ID NO: 365771 - DNA, 588 bp, Homo sapiens
  misc_feature: GZ8MTXP01ARAK8.51.53.E09.1.454.CMB.2.raw
  modified_base (331)..(331): a, c, t, g, unknown or other
  modified_base (343)..(343): a, c, t, g, unknown or other
  modified_base (386)..(386): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgactattggtacttataattctgtctcctggtaaccaacaactaccccggacaaacgtccccaaactcatgatctttgaggtcagtgatccgggcccgngtaggggtttcncatcgcttctccccggctcaagtctggcagcacggccctcccncgaccactctcgtgggctccgaggctggaggacgaggctgtattacttactcgcaggctacataactaaacaaacgaagaaactacggtttgggtcggttcgggccgggacgggtaaccaaacgttcgtaacccgttccgtaccgtcacgcccgaacggcctccggcccccttgggccttaccgttccgttccgttcccccg

SEQ ID NO: 365772 - DNA, 649 bp, Homo sapiens
  misc_feature: GZ8MTXP01CHQTV.51.53.E09.1.454.CMB.2.raw
  modified_base (290)..(290): a, c, t, g, unknown or other
  modified_base (448)..(448): a, c, t, g, unknown or other
  modified_base (485)..(485): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcacatctcctgcacgtacgaaaccacaatgactattgtaacttataattctgtctctacgtaaccaaacaacgtaccccgganaaaccgtacccaaatcatgtaattcttaggaggtcagtcgaacgtccgggcccgtcggttagggtttcactacgtccggtctttccgtccccggtctacgtaagtcgtaggacgacgtcccgaccgggtccctccctacgacctactcgtcgcggtcnccgaggctaggacggacgacgtgtagtattactacgngctacgtactacaaataacaaaacgaaacgaacgtaacgtacgggtttgggtaccggtaccgggaccggaaccgtaaccaacgttccgtaccgttacgaccgtacgaccgccgacggtcccgtcccgtccccgtacgtccttaccttcccgttcccgtaacccc

SEQ ID NO: 365773 - DNA, 580 bp, Homo sapiens
  misc_feature: GZ8MTXP01EPJ5Y.51.53.E09.1.454.CMB.2.raw
  modified_base (255)..(255): a, c, t, g, unknown or other
  modified_base (329)..(329): a, c, t, g, unknown or other
  modified_base (340)..(340): a, c, t, g, unknown or other
  modified_base (351)..(351): a, c, t, g, unknown or other
  modified_base (465)..(465): a, c, t, g, unknown or other
tcagcgatcgtatacacgaccggtgctcgatttagagagagtgtgttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactagaaccacaatgactattgtacttataattcngtctctaggtaaccaacaactacccggacaaacgtaccccaaactcatgattctttgagtcagtgatcggccgngtagggtttcntatcgcttccncccggctacagtctggacaagcccgacgccctcccagacctatcgtcgtggcctccgaggctacggaggaaccgagtaccttagtattacttacgtgctaacgctactaataanaaacaaaacgagtaaacgtcggttagggtcgtcgggcggacgggaacaacgttgacccgttcgtacgtcacgccagcccacgtccccgtggtccttacctcttcccgttaacccc

SEQ ID NO: 365774 - DNA, 654 bp, Homo sapiens
  misc_feature: GZ8MTXP01CK0RQ.51.53.E09.1.454.CMB.2.raw
  modified_base (482)..(482): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactggaaccacaatgactattgtacttatattctgtctctgtaccaacaactaccccggacaaacgtaccccaaactcatgtacttcgtttgagtcagtgagtccggccgtcgtacggggtttctctactcgtcttcgtccccggctacgtaagtcgtggacacgccgaccggtccctcccgtacgacctatccgtcgttcggggccttcccgagggtcaggacgggacgtacggtctagtattacgtactgaccaggtccttanaattaacgaaacaaaacgtaacgtaaacgttaacggttggggtacggttaccgggacggggaccgggaaacctaaacgttcggtaaccccgttcgtaaccgtcaaccggcccgaacggtccctacccggtccccgtcggtacccttaccgttcccgttccggtttccccccg

SEQ ID NO: 365775 - DNA, 612 bp, Homo sapiens
  misc_feature: GZ8MTXP01A5X1Z.51.53.E09.1.454.CMB.2.raw
tcagcgatcgtatacacgaccggtgctcgatttagagagagtgtgttggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgactattgtacttatattctgtctctgtaccaacactacccgacaaacgtcccaaactcatgatcttgagtcagtgatcggccgcgtagggtttctcatcgcttcgtccccggctacagtctcggacacgcacggccctccctcgacctatctcgtcgggcctccgaggcgtaggaggacgaggtctagtacttattacgtgacacggtctactaattaacaaacaaaaccgaagtaaacgtaacggtttgggtacggttaccgggacgggaaccgggtaacctaaacggttcggtaacccgttcgtaacgtacacggcccgaacgggtcctcccggaaccccgttcggtaccttaccgttccttcccggtttcccccg

SEQ ID NO: 365776 - DNA, 788 bp, Homo sapiens
  misc_feature: GZ8MTXP01ALXNR.51.53.E09.1.454.CMB.2.raw
  modified_base (250)..(250): a, c, t, g, unknown or other
  modified_base (318)..(318): a, c, t, g, unknown or other
  modified_base (331)..(331): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatctcctgcactggaaccacaatgactattgtacttatattcngtctctgtaccaacaactacccggcaaacgtcccaaactcatgatctttgagtcagtgactcggccgngtacggggtttcnctacgtcgtcctttccgtccccggtacctaccgtaagtccgtacggccaacgggcccgtaacccgggccccttaccccggtcgaacccctagttcccgtttccgtcgggggtaccttcccggaacgggtccggtagggaacggggaaccggaggttaccgtagggttaactttaacgtaacgttcgaaccgacgggtacttaaccgtaaataaaccgttaaaacaaaaaccgaacggtaaaaaccgtacggggttttacgggggttaccgggttacccgggggaacccggggtaacccgggggaaaaccccttaaaacgggttacccgggtaaccccgttcccgttaaaccggttacccgaaaccggttacccccgaaagggggttccccctcccggaacccccccggtttccgggtaacccgttccttaaccccggtttccccgttaacccccccg

SEQ ID NO: 365777 - DNA, 665 bp, Homo sapiens
  misc_feature: GZ8MTXP01AWLET.51.53.E09.1.454.CMB.2.raw
  modified_base (291)..(291): a, c, t, g, unknown or other
  modified_base (389)..(389): a, c, t, g, unknown or other
  modified_base (424)..(424): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccaccaatgactattgtacttatattctgtctctgacaacactacccgacaacgtcccaatcatanatcttgagtcagtgatccgccgcgtacgggttctcgatcgtcttccgtccccgcctcaacgtccgtcggacacgcccgaccggtccctccctcgaccnctccgtcgtcgggctccaggcgtaggacggacggnggtactagtaacttagttaccgtgacgtagtacctacgtaaattaacgtaaaaccgaaacgtaaacgtaaaccgttacggtttagggttccggggttacccgggaccggggtacccgggtaaaccgtaaaccgttccggtaaccccggttccgtaaacccggtcgaacccggcccgaccgggtcccgttacccccgccccggtttcggacccttacccggttcccttcccggtttcccccc

SEQ ID NO: 365778 - DNA, 620 bp, Homo sapiens
  misc_feature: GZ8MTXP01C3YI3.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccacaatgactagttgtacttataattctgtctctggtaccaacaactacccggacaaacgtacccaaactcatgatcttagagtcagtgacgtcggcccgtgtagggggttcctcgatcgtcttccgtccccggtctacgtaagtctggacacgcaccgggcctccctagacctatctcgtcggctacacggctgaggacgagtctagtaacttagtatgacagggcttacaattacgaaacaaaacgacgaaactaacggttgggtacgttcgggcgggaaccggggaacctaaaacgttccggtaaccgttccgttaaaccggtcaacggcccgaaacgggtcctacccgtccccgtccgggtaccttaccgtttccttcccggtttaacccccg

SEQ ID NO: 365779 - DNA, 588 bp, Homo sapiens
  misc_feature: GZ8MTXP01A594O.51.53.E09.1.454.CMB.2.raw
  modified_base (326)..(326): a, c, t, g, unknown or other
  modified_base (337)..(337): a, c, t, g, unknown or other
  modified_base (379)..(379): a, c, t, g, unknown or other
  modified_base (384)..(384): a, c, t, g, unknown or other
  modified_base (427)..(427): a, c, t, g, unknown or other
  modified_base (539)..(539): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaaccaccaatgactattggtacttataattctgtctctgtaccaacactaccccggacaaacgtccccaaatcatgatcttgagtcagtgatccggccgngtagggtttcnatcgtctcgtcccggctacgagtcgtgcagccacggccctcncaccntcgtcgtggctccgaggctggagacgtagctagacttagttcngacaggtcctatactaaacgtaaccaaaacgtaacgtaaactacgggttggggtcggtaccgggtccgggaccgggtaaactaacgttccggtaacccttccgtaccggacnccggacccgacgggtcctcccgcccgtcgcttacctccgttccgtcccc

SEQ ID NO: 365780 - DNA, 676 bp, Homo sapiens
  misc_feature: GZ8MTXP01CA4V8.51.53.E09.1.454.CMB.2.raw
  modified_base (309)..(309): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactagaaccacaatgactattgtacttatattctgtctctagtaccaacactacccggacaaacgtacccaactcatgtatcttggagtnagtgacgtccggcccgaggttacgggggtttctcgtacttccggtcctttccgtacccccggtcctaccgaagttccgtggaccgacgcccgacccgggtccctcccgtcgaacctcgtctcggtcggctccgaggcgtaggacggacgtggctgtaattacgttatcgcgacgtcctataaactaactaaacaaacgtaaacgtaacgttacgggttggggtacgggttaccgggaccgggtaacgggtaaaccctaacgggttccggtaaaccccgttcccgttaaaccgggcttaaccccgggcccgaacggtcccgtaccccggttccccgtcggtaccttccctttccgttccgtttccccc

SEQ ID NO: 365781 - DNA, 618 bp, Homo sapiens
  misc_feature: GZ8MTXP01A1CDT.51.53.E09.1.454.CMB.2.raw
  modified_base (255)..(255): a, c, t, g, unknown or other
  modified_base (302)..(302): a, c, t, g, unknown or other
  modified_base (407)..(407): a, c, t, g, unknown or other
  modified_base (473)..(473): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccacaatgactattggtacttataattctntctctagtaccaacaactacccgacaaacgtacccaaatcatgattntttagagtcagtcgacgtccggcccggtgttacgggttcactacgtccgtcttcctccccggcttaccaagtcctggacacgccgacgtccctcctacgaacctntctcgtgcctaccgaggtctaggaggacgaggtctagtattatactaggtcacggtctaactaaanaactaaacaaacgtaagtaaacgtaggttcggtcggtaccgggaccggaaccgaaacctaacgttccgtacccgttccgtacgacgaccgacccgttacggtccgtcccgccccgttcgtaccgttaccttccgttcccgtcccg

SEQ ID NO: 365782 - DNA, 750 bp, Homo sapiens
  misc_feature: GZ8MTXP01DBXC3.51.53.E09.1.454.CMB.2.raw
  modified_base (450)..(450): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgaaccacaatgactagttagtacttatacttctgtctctgtaaccaacaactaccccggacaaacgtaccccaaactctactgtattcgtttagacggtcagtacgacgtccggcccgtacgggttagggggtttccttacgtacgttcgtcgtttccgtccccggcctaccgtaaacgtcgtcggaccacgccgtaaccggtccccttcccacgaaccctgttccnccgttacgggcctccgaggcgtaggacgggacgagggtccttaggtacttaacgtcgtcggacacgtaccttataaactttaacaaaaccgaaacgaaacgttaaacgtacgggttttcggggttacggttaccgggaccggggtaccgggtaaaccctaaccggttacggtaccccgttacccgttaaacgggtccccaaccgggaccccttaaacggggttcccctacccccgggggttccccccttcggggttccccttaaacccggtttccccgttcccgggttttcccccccccg

SEQ ID NO: 365783 - DNA, 588 bp, Homo sapiens
  misc_feature: GZ8MTXP01BPW6D.51.53.E09.1.454.CMB.2.raw
  modified_base (326)..(326): a, c, t, g, unknown or other
  modified_base (336)..(336): a, c, t, g, unknown or other
  modified_base (367)..(367): a, c, t, g, unknown or other
  modified_base (441)..(441): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactaggaaccacaatgactattgtacttatattctgtctctgtaccaacaactacccgacaaacgtccaacaaactcatgattcttgagtcagtgacgtcggcccgngtagggttcncatcgcttccgccggtctaccgagtctcgcngccaccggccctccctgaccatcctcgtacggctcgagctggacggacgagctagtatatactgacgagtctanaactaactaaacaaacgaagtaaacgtcgttggggtacggtacggccgggtaaccggaaccgttaaacgtcgacccgtaccgtaccgacgttccgacccgtaacggcccgtccgtccccgtacgttccctaacgttcccgttccccg

SEQ ID NO: 365784 - DNA, 780 bp, Homo sapiens
  misc_feature: GZ8MTXP01CMAP2.51.53.E09.1.454.CMB.2.raw
  modified_base (198)..(198): a, c, t, g, unknown or other
  modified_base (355)..(355): a, c, t, g, unknown or other
  modified_base (399)..(399): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacngtcgatcaccatctcctgcactaggaaccaccaatgactattggtacttataattctagtctctggtaccaacaactaccccggacaaacgtcccaaactcatgacttcttgaggtcagtcgacgtccggcccgcgtaggggttctcgatcgcttcnccccgtctacagtcgtacgcgacgccgaccggtccctcccgtanacccgtatcctcggtcgggtccgttacccgaggtccgtaggaacgggaccggtaggtacgttacggtaaatttaacgttacgttacggcgtaacggggtactacctaaacgttaaacttaaaccgaaaacccgtaacggtaaaaccgttacgggggtttaacggggttccggttacccgggggtaccgggggtaaaccccgggtaaacccggttaaaaaccgttcccgggtaaaaccccggttcccgggttaaacccggttaccggaaaccccgggttaaccccggttaaaccggggtccccgttaccccccgggttccccccggttaaccggttcccgttaacccgtttccccgggttcccgttttcccccccccccggg

SEQ ID NO: 365785 - DNA, 527 bp, Homo sapiens
  misc_feature: GZ8MTXP02GJCG2.51.53.E09.1.454.CMB.2.raw
  modified_base (448)..(448): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatctttgagtcagtgatcggcccgcaggggtttctcatcgcttctcccggctccaagtctggcagcacggcctccctgaccatctctgggctcccaggctgagacgaggctgattatactgcagctcatatacaaacagaaacacttagggngttcgggcggcgggaaccaaaacgtcgaccgtctaacgtcacgccaaggctcgccccctggtccactctcgttcccccg

SEQ ID NO: 365786 - DNA, 522 bp, Homo sapiens
  misc_feature: GZ8MTXP02GC697.51.53.E09.1.454.CMB.2.raw
  modified_base (440)..(440): a, c, t, g, unknown or other
  modified_base (449)..(449): a, c, t, g, unknown or other
  modified_base (498)..(498): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccccggctccaagtctggcagcacggcctcctgaccatctctgggctccagctgagacgaggctgattatactgcagctcatatacaaacagaaacncgttagggngttcggcggacgggaccaaaacgtgaccgtctacggtcacgccaaggcncgcccctcggtcactctcgtcccc

SEQ ID NO: 365787 - DNA, 522 bp, Homo sapiens
  misc_feature: GZ8MTXP02GUHTR.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatctttgaggtcagtgatcggccgcaggggtttctcatcgcttctccccggctccaagtctggcagcacggcctccctgaccatctctgggctccaggctgaggacgaggctgattatactgcagctcatactacaaacagaaacacgttgggagttcggcggcgggaaccaaacgtgaccgtcctacgtcacgcccaagctcgcccctcggcactctcgttcccc

SEQ ID NO: 365788 - DNA, 515 bp, Homo sapiens
  misc_feature: GZ8MTXP02GUHIT.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatcttgaggtcagtgatcggcccgcaggggtttctcatcgcttctcccggctccaagtctggcagcacggcctccctgaccatctctgggctccagctgagacgagctgattatactgcagctcatatacaaacagaaacacgtggtagttcggcggcgggacaaacgtgaccgtctacgtcacgccaaggctacgcccctcgtcactctcgttcccc

SEQ ID NO: 365789 - DNA, 557 bp, Homo sapiens
  misc_feature: GZ8MTXP02JCUZB.51.53.E09.1.454.CMB.2.raw
  modified_base (340)..(340): a, c, t, g, unknown or other
  modified_base (380)..(380): a, c, t, g, unknown or other
  modified_base (391)..(391): a, c, t, g, unknown or other
  modified_base (394)..(394): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatcttgaggtcagtgatcggccgcaggggtttctcatcgcttcnccccggctccaagtctggcagcacggcctcctgaccatcnctgggctccgngcngagacgagctgattatatgcagctacataactaacaaacaacgaaactacgttagggtcgtcggacggacggaaccaaacgtcgtacccgtaccgtacgtaccgacgacccgaacggtccgtccggtcccccgtcggtacctaccttccgttaccgttccccg

SEQ ID NO: 365790 - DNA, 538 bp, Homo sapiens
  misc_feature: GZ8MTXP02GCV4B.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaataccccggcaaagtccccaaactcatgatcttgaggtcagtgatcggcccgcaggggtttctcatcgcttctcccggctccaagtctggcagcacgcctcctgaccatctctcgggctccagctgagacgagctgattatactgcagctcatataacaaaacagaaactacgttagggtgttccggcggtcgggaaccaaacgtacgacccgtacctacggtcacgaccccgaaggcctcgcccctcggtccacgtcctcgttaccccc

SEQ ID NO: 365791 - DNA, 518 bp, Homo sapiens
  misc_feature: GZ8MTXP02GAGHJ.51.53.E09.1.454.CMB.2.raw
  modified_base (465)..(465): a, c, t, g, unknown or other
  modified_base (491)..(491): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatcttgagtcagtgatcggcccgcaggggttctcatcgcttctcccggctccaagtctgcagcacgcctcctgaccatctctgggctcccaggctgagacgaggctgattatactgcagctcatatacaaacagaaacacgttaggtgttcggcggcggaccaaaacgngaccgtccacgtcacgcccaaggccncgcccctcggtcacctctcgttccccc

SEQ ID NO: 365792 - DNA, 524 bp, Homo sapiens
  misc_feature: GZ8MTXP02GSR52.51.53.E09.1.454.CMB.2.raw
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccgacaaagtccccaaactcatgatctttgaggtcagtgatcggccgcaggggtttctcatcgcttctccccggctccaagtctggcagcacggcctcctgaccatctctgggctccagctgagacgaggctgattatactgcagctcatataacaaaacagaaacacttgggtgttcggcgcgggaccaaaactcgaccgtctacgtcacgccccaaaggctcgccccctcggtcactctcgttcccccg

SEQ ID NO: 365793 - DNA, 552 bp, Homo sapiens
  misc_feature: GZ8MTXP02IKZRH.51.53.E09.1.454.CMB.2.raw
  modified_base (271)..(271): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgacattggtacttataattctgtctctgtacacaatacccgnaagtcccaaactcatgatcttgagtcagtgatcggcccgcgagggtttctcatcgcttctcccgctccagtctggcagcacggcctccctgacccatctctgggcctcccgaggctggaaggacgaggctagattatactgcagctacatataaacaaacagaaactcgttagggtgttacgggcggacgggaaccaaaacgttcgaacccgttacgtaccgtaccgaacgcccaaagggccttccggaccccctcggtaccaccttcctcgtttaccccc

SEQ ID NO: 365794 - DNA, 556 bp, Homo sapiens
  misc_feature: GZ8MTXP02HT04N.51.53.E09.1.454.CMB.2.raw
  modified_base (318)..(318): a, c, t, g, unknown or other
  modified_base (413)..(413): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaatacccggcaaagtccccaaactcatgatcttgagtcagtgatcggcccgnaggggtttctcatcgcttctcccggctccaagtctggcagcacggcctcctcgaccagtctactcgggcctccgaggctgaggacgagcggggtnagttatacgtgcagctcgatactaacaaacagaaactacgttcgggtgttacggcggtacgggaaccaaacgtacgaccgtccgtaacgtcgacgacccgaaaggcgtcgaccccgtacggtctaccgtctcgtttacccccg

SEQ ID NO: 365795 - DNA, 677 bp, Homo sapiens
  misc_feature: GZ8MTXP02HTH9X.51.53.E09.1.454.CMB.2.raw
  modified_base (412)..(412): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccgacgaacaaccaacccaactcatagtactttcgttaggacgtacgtaggtacgtacggtcccggcccgtacggggtttacgggtttcctactacgtcgttccttccccgtcccgtcctacgtaacgttcgtacggacncgacgcccgtccctcccgtacgacctacttcctcggtcggtcctacgacggtcgagggaacggacggacgtcgtattaacttactacgtcgacgtctacaactaataaactaaaacaagaaaacgtaaacgttcgggtttagggtaccggtaccggggacggggtaaccgaaaacccgtaaagtcccggtacccgttaaccgtacgacgtacccgaacgaacggtcctaccccggtcccgtacgtacctacctttcggttccccc

SEQ ID NO: 365796 - DNA, 531 bp, Homo sapiens
  misc_feature: GZ8MTXP02G6XGA.51.53.E09.1.454.CMB.2.raw
  modified_base (323)..(323): a, c, t, g, unknown or other
  modified_base (333)..(333): a, c, t, g, unknown or other
  modified_base (419)..(420): a, c, t, g, unknown or other
  modified_base (427)..(427): a, c, t, g, unknown or other
  modified_base (432)..(432): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggacaaagtccccaaaactcatgatctttgaggtcagtgatcggccgnaggggtttcncatcgcttctccccggctccaagtctggcagcacggctccctgaccatctctgggctccgaggctgagacgaggctgattattacnncagctanataanaaacaaacagaaacgtagttgggtgtacgggacggacggaaaccaacgtcgaccgtcctacgcacgaccgaagcctccgccctcgtcacctctactccc

SEQ ID NO: 365797 - DNA, 549 bp, Homo sapiens
  misc_feature: GZ8MTXP02HRLTL.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaataccccggcaaacgtccccaaactcatgatctttgagtcagtgatcggccgcgtaggggttctcatcgctctcccgctccagtctgcagcacgcctcctgaccatctcgtgggcctccgaggctggaggacgaggctgattattactgcagctacatataacaaacagaaacacgttgggtgttcgggcggacgggaaccaaaacgtcggacccgtaccgtacgtacacgacccgaacggcctccggccccctacggtccaccgtccttcgttcccccg

SEQ ID NO: 365798 - DNA, 631 bp, Homo sapiens
  misc_feature: GZ8MTXP02F7HDQ.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaacgtccccaaactcatgatcttgagtcagtgatcggcccgcaggggtttctcatcgcttctcccggctccaagtctggcagcacggcctccctgaccatctcgtcggcctcgagcgtagaggacgaggtctagtattactcgtgaccagtcctactaattaactaaacaaaacgaaacgtaaaacctacggtttaggggtcggttaccgggacggggtacccgggaaaacctaaaaccggttaccgtaaccccgttaccgtaaccgtaccgaaccgaccccgaacgggtccctccccggtacccccgttaccggtaccgtacccgtttcgttaccccgtttacccccccg

SEQ ID NO: 365799 - DNA, 552 bp, Homo sapiens
  misc_feature: GZ8MTXP02IXCL9.51.53.E09.1.454.CMB.2.raw
  modified_base (277)..(277): a, c, t, g, unknown or other
  modified_base (429)..(429): a, c, t, g, unknown or other
  modified_base (437)..(437): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtaccaacaataccccgnaaacgtcccaaactcatgatcttgagtcagtgatcggccgctaggggtttctcatcgcttctcccgctccagtctggcagcatcggcctccctgaccatctcgtggactccgaggctgaggacgaggctagattatactgcagtctacatanaaacaaanaagaaactacgttagggtcgttcgggcggaccgggtaaccaaaacgtcggaacccgtccgtacgtaccgacgacccgaacgggcctccggccccctcggtccaccgtcgttcccg

SEQ ID NO: 365800 - DNA, 526 bp, Homo sapiens
  misc_feature: GZ8MTXP02JUHVG.51.53.E09.1.454.CMB.2.raw
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatctttgaggtcagtgatcggcccgcaggggtttctcatcgcttctcccggctccaagtctggcagcacggcctccctgaccatctctgggctccaggctgagacgagctgattatactgcagctcatatacaaacagaaacacgttgggtgttcggcggcgggtaaccaaaactcgaaccgtcctaacgtcacgcccaaggcctcgcccctcggtcactctcgttccccc

SEQ ID NO: 365801 - DNA, 521 bp, Homo sapiens
  misc_feature: GZ8MTXP02HUQWC.51.53.E09.1.454.CMB.2.raw
  modified_base (433)..(433): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtacaacaatacccgcaaagtcccaaactcatgatctttgaggtcagtgatcggcccgctaggggtttctcatcgcttctcccggctccaagtctggcagcacggcctccctgaccatctctgggctcccaggctgaggacgaggctgattatactgcagctcatatacaaaacanaaacactggtgttcggcggcgggaaccaaacgtgaccgtctaacgtcacgcccaaaggcctcgccccctcggcacctcttcttacccc

SEQ ID NO: 365802 - DNA, 522 bp, Homo sapiens
  misc_feature: GZ8MTXP02IUOEA.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatctttgaggtcagtgatcggcccgcaggggtttctcatcgcttctcccggctccaagtctggcagcacggcctccctgaccatctctgggctccagctgagacgaggctgattatactgcagctcatatacaaaacagaaacacgttagggtgttcgggcggtcgggaaccaaactgaccgtctacgtcacgccaaggctcgcccctcggtcactctcgttcccc

SEQ ID NO: 365803 - DNA, 529 bp, Homo sapiens
  misc_feature: GZ8MTXP02FWLER.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtaccacaatacccggcaaagtcccaaactcatgatcttgagtcagtgatcggccgcaggggttctcatcgcttctccccggctccaagtctggcagcacggcctcctgaccatctctgggctccagctgaggacgaggctggattatactgcagctcatactaacaaaacagaaaactacgttagggtcgttcggcgggacggaaccaaaacgtcgaccgtacctacgtcacgcccaaggcctcgccccctcggtcactctcgttccccg

SEQ ID NO: 365804 - DNA, 522 bp, Homo sapiens
  misc_feature: GZ8MTXP02G8M4J.51.53.E09.1.454.CMB.2.raw
  modified_base (425)..(425): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatctttgagtcagtgatcggccgcaggggtttctcatcgcttctcccggctccaagtctggcagcacggcctccctgaccatctctgggctcccgaggctgaggacgaggctgattattactgcagctnatataacaaacagaaacagttagggtgttcggcggcggaacaaacgtgaccgtccacgtcacgcccaaggctcgcccctcggcactctcgttccccg

SEQ ID NO: 365805 - DNA, 529 bp, Homo sapiens
  misc_feature: GZ8MTXP02JUUUO.51.53.E09.1.454.CMB.2.raw
  modified_base (502)..(502): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatctttgagtcagtgatcggccgcaggggttctcatcgcttctccccggctcaagtctggcagcacggcctccctgaccatctctcgggctccgaggtctggaggacgaggctgattattactgcagctcatataacaaacagaaacacgttgggtgttacggcggcgggaccaaaacgtgacccgtctacgcacgcccaaggccncgcccctcggtcacgtctcgttccccc

SEQ ID NO: 365806 - DNA, 585 bp, Homo sapiens
  misc_feature: GZ8MTXP02H3OC5.51.53.E09.1.454.CMB.2.raw
  modified_base (325)..(325): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggacaaacgtccccaaactcatgatctttgaggtcagtgatcggcccgntaggggtttctcatcgtctctccccggctccaagtctggcagccacggcctccctgaccagtctctcgggcctccgaggcctaggacgggacgaggctaggatttattaactgaccagcttcaatactaacaaaacaagaaaactacgttgggtcgtttacgggcgggaccgggaaccaaaacgttcggaacccgtaccgtacgtacacgcccgaaacggccgttcgcccccgtcggtacctacctccttaccgtccccc

SEQ ID NO: 365807 - DNA, 530 bp, Homo sapiens
  misc_feature: GZ8MTXP02H7D47.51.53.E09.1.454.CMB.2.raw
  modified_base (320)..(320): a, c, t, g, unknown or other
  modified_base (329)..(329): a, c, t, g, unknown or other
  modified_base (435)..(435): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgacattggtacttataattctgtctctggtaccaacaataccccggacaaacgtccccaaaactcatgatcttgagtcagtgatcggcccgnagggtttcncatcgcttctcccgctccaagtctggcagcacggctccctgacccatctctcgggctccgaggctgaggacgaggctagattatactgcagctacatatacaaaanagaaactacgttgggtcgtcggacggaccgggaacaaacgtcgaaccgtcctacgtcacgccaagcctacgcccctcggcacctctccgtccccg

SEQ ID NO: 365808 - DNA, 532 bp, Homo sapiens
  misc_feature: GZ8MTXP02IVHME.51.53.E09.1.454.CMB.2.raw
  modified_base (428)..(428): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccacaatgacattggtacttataattctgtctcctggtaccaacaataccccggcaaagtccccaaactcatgatcttgagtcagtgatcggccgcaggggtttctcatcgcttctccccggctccaagtctggcagcacggcctccctgaccatctctgggctccagctgagacgaggctgattatactgctagctcattaaanaacaaacaacaaactagttgggtcgtacggcggaccggaacaacgtcgaccgtcctacgtcacgaccgacgccgccgaccccgtcgtcctactcctccgtcccc

SEQ ID NO: 365809 - DNA, 536 bp, Homo sapiens
  misc_feature: GZ8MTXP02FZEQQ.51.53.E09.1.454.CMB.2.raw
  modified_base (279)..(279): a, c, t, g, unknown or other
  modified_base (429)..(429): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaataccccggnaaacgtccccaaactcatgatctttgaggtcagtgatcggccgcgaggggtttctcatcgcttctcccggctccaagtctgcagcacggcctcctcgaccatctctgggctccaggctaggagacgaggctagattagtactgcagctanatactaacaaaacagaaactcgttagggtcgttacgggcggacgggaaccaaacgtcgacccgtctacgtcacgccaagctcgcccctacggcacgtctcgttcccc

SEQ ID NO: 365810 - DNA, 533 bp, Homo sapiens
  misc_feature: GZ8MTXP02JWZBY.51.53.E09.1.454.CMB.2.raw
  modified_base (407)..(407): a, c, t, g, unknown or other
  modified_base (445)..(445): a, c, t, g, unknown or other
  modified_base (474)..(474): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccccggctccaagtctggcagcacggcctccctgaccatctctgggctccaggctgaggacgnggctgattattactgcagctcatatacaaacagaaacncgttgggtgttcggcggcgggaccaaacngaccgtcctacgtcacgcccaaggccgtcgccccctcggtccactccgtcgttcccccg

SEQ ID NO: 365811 - DNA, 528 bp, Homo sapiens
  misc_feature: GZ8MTXP02IF9VY.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtacacaatacccgcaagtcccaaactcatgatcttgaggtcagtgatcggcccgcaggggtttctcatcgcttctcccggctccaagtctggcagcacggcctccctgacccatctctgggctcccaggctgagacgaggctgattatactgcagctcatataacaaacaagaaacagttagggttttcggcggtcggggaccaaaacgtcgaccgtcctacgtacacgacccaagcctcgccccctcggtccactcctcgtccctcccc

SEQ ID NO: 365812 - DNA, 559 bp, Homo sapiens
  misc_feature: GZ8MTXP02JQUGY.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaacgtccccaaactcatgatctttgaggtcagtgatcggcccgcgtaggggtttctcatcgcttctccccggctccagtctggcagcacggcctccctgaccatctcgtgggcctccgaggctggaggacgaggctgattattactgcagctcatataacaaaacaagaaactcgttggggtagttccgggacgggacggaaccaaaacgtcgaccgtccgttaacgtcacgcccaaggcctccgcccccgtcggtacctaccgtctccgttcccccg

SEQ ID NO: 365813 - DNA, 669 bp, Homo sapiens
  misc_feature: GZ8MTXP02HH9QW.51.53.E09.1.454.CMB.2.raw
  modified_base (527)..(527): a, c, t, g, unknown or other
  modified_base (542)..(542): a, c, t, g, unknown or other
tcagcgatcgtatacacgaccggtgctcgatttagagagagtgtgttgggtttggggggttctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgacattggtacttataattctgtctctgaccaacaactacccggacaaacgtaccccaaactcatcgtatcgtttgaggtcagtgacgtccggcccgacgttacggggtttctctacgttccgtcctttccgtcccccggtaccttaccgtaaacgttccgtacggccgaacggcccgacccgggtcccttacccccgtacgaccctacgtcctccgggtcgggtccctacccggtaagggccgttagggaacggaacgggtcggtacgttagtaacttattaccgtgacagtctanaataactaacaaaanacgaaacgtcggttggtcggttaccgggacgaccgggaactaaaacgtcgtaaccgtacgtacgccgaacgcccgaacggccgtacccgtccccgttacggacctaccgttcttacccggttccccc

SEQ ID NO: 365814 - DNA, 516 bp, Homo sapiens
  misc_feature: GZ8MTXP02JHQHP.51.53.E09.1.454.CMB.2.raw
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatcttgaggtcagtgatcggcccgcaggggtttctcatcgcttctcccgctccagtctggcagcacggcctccctgaccatctctgggctcagctgagacgaggctgattagtactgcagctcatatacaaacagaaactcttgggtagttcgggcggcggaccaaactgaaccgtctaacgtcacgcccaaggctcgccctcggcactctcgttccccc

SEQ ID NO: 365815 - DNA, 570 bp, Homo sapiens
  misc_feature: GZ8MTXP02H4WYZ.51.53.E09.1.454.CMB.2.raw
  modified_base (319)..(319): a, c, t, g, unknown or other
  modified_base (329)..(329): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctggtacaacaataccccggcaaacgccccaaactcatgatcttgagtcagtgatcggcccgnaggggtttcncatcgcttctccccggctccaagtctggcacgcaccggcctccctgacccatctctcgggctccgagctgagacgagctgattatactgcagctacatactaacaaacaagaaactacgttagggtacgttcgggacggaccggggtaacaaaacgtcgaccgtaccgtacgtaccgacgcccgaaacggtccgttaccgaccccccgttcggtaccaaccgttcctttaccgttcccccc

SEQ ID NO: 365816 - DNA, 540 bp, Homo sapiens
  misc_feature: GZ8MTXP02IUAN2.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctggtaccaacaatacccggcaaagtccccaaactcatgatctttgaggtcagtgatcggcccgcaggggtttctcatcgcttctccccggctccaagtctggcacgcacggccctccctgacccatctctgggctccagggctgagacgaggctgattatactgcagctcatatacaaaacagaaacacgttagggtgttcgggcgacggggaacctaaacgtacgacccgtccgtaacgtcacgcccaaggctcgccccctcggccactcctcgttcccccg

SEQ ID NO: 365817 - DNA, 554 bp, Homo sapiens
  misc_feature: GZ8MTXP02JXAB5.51.53.E09.1.454.CMB.2.raw
  modified_base (386)..(386): a, c, t, g, unknown or other
  modified_base (434)..(434): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaactaccccggcaaagtccccaaactcatgatctttgaggtcagtgatcggccgcaggggtttctcatcgctttctcccggctccaagtctggcagcacggcctccctgaccatctcncgggctccaggctgaggacgagctgattatactgcagctcatactaanaaacagaaaactcgttagggtgttcgggacggcggggaaccaaaacgtcggacccgttcttaacgccacggaccccaagggcctacgcccccgtcggtaccaccgttcctcgtttccccc

SEQ ID NO: 365818 - DNA, 541 bp, Homo sapiens
  misc_feature: GZ8MTXP02IMANG.51.53.E09.1.454.CMB.2.raw
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcgaggggtttctcatcgcttctcccggctccagtctggcagcacggcctccctgacccatctctgggctccagctgagacgagctagattatactgccagcttcaatactaaacaaaacacgaaaactacgttagggtcgttcgggcgggaccgggaccaaaacgtcggacccgtcctacgtcacgcccaaggctcgcccctcggtcactctcgttcccc

SEQ ID NO: 365819 - DNA, 555 bp, Homo sapiens
  misc_feature: GZ8MTXP02I45X0.51.53.E09.1.454.CMB.2.raw
  modified_base (300)..(300): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtaccaacaatacccggcaaagtccccaaactcatgatcttnaggtcagtgatcggcccgcaggggtttctcatcgcttctcccggctccaagtctggcagcacggcctccctgaccatcctctcgggctccaggctgagacgaggctgattatactgcagctcatataacaaaacagaaacacgttagggtgtttcggggaccggcggggtaacccaaaacgttcggaacccgttcctaccggtcaacgcccgaaaggtcctccgccccctcggtaccacctcctcgtttcccccg

SEQ ID NO: 365820 - DNA, 559 bp, Homo sapiens
  misc_feature: GZ8MTXP02IIHFQ.51.53.E09.1.454.CMB.2.raw
  modified_base (333)..(333): a, c, t, g, unknown or other
tcagcgatcgtatacacgaccggtgctcgatttagagagagtgtgttgggtttgggggggtctcaggaggcagcgctctcgggacgtctccaccatggcctgggctctgctattccctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtaccaacaatacccggcaaatccccaaactcatgatctttgaggtcagtgatcggcccgcgtaggggtttcncatccgcttctccccggctccaagtctggcagccacgccctccctgaccatctctcgggctccgaggctggaggacgagggctgattatactgccagctacatataacaaaacagaaactcgttaggtgttacggcggaccgggaaaccaaacgtcgacccgtacctacgtaccgacgccctaagggccttccggcccccttcggtccacgttcctcgtttccccc

SEQ ID NO: 365821 - DNA, 552 bp, Homo sapiens
  misc_feature: GZ8MTXP02HQT9U.51.53.E09.1.454.CMB.2.raw
  modified_base (330)..(330): a, c, t, g, unknown or other
  modified_base (342)..(342): a, c, t, g, unknown or other
  modified_base (446)..(446): a, c, t, g, unknown or other
  modified_base (448)..(448): a, c, t, g, unknown or other
  modified_base (453)..(453): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccaccaatgactattggtacttataattctgtctcctggtaccaaacaactaccccggacaaacgtccccaaactcatgatctttgaggtcagtgagtcggcccgngtaggggtttcncatcgcttcctcccggtctccaagtctggcagccacggcctccctgacctatctcgcgggactccgaggctggaggacgaggctgtaacttatactgcagctananataanaaacagaaactacgttgggtgttcggcgggacggaaccaaaacgtcgaccgtctacgcacgcccgaaggcctcgccccgtcgcacctcgtcttcccccg

SEQ ID NO: 365822 - DNA, 533 bp, Homo sapiens
  misc_feature: GZ8MTXP02JS35S.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccccggctccaagtctggcagcacggcctccctgaccatctctggggctccaggctgaggacgaggctgattatactgcagctcatataacaaaacagaaacacgttagggtgttcggcggcgggaccaaaacgtgaccgtccacgtcacgcccaaggcctcgccccctcggtccactctcgttcccccg

SEQ ID NO: 365823 - DNA, 700 bp, Homo sapiens
  misc_feature: GZ8MTXP02JR6U5.51.53.E09.1.454.CMB.2.raw
  modified_base (466)..(466): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttatattctgtctctgtaccaacaactacccggacaaacgtaccccaaactcatgtacttcgtttagagtcagtgacgtccggccgtcgtacggggtttctcacgtcgtcttccgtcccccggtcctaccgtaacgttcgtcggaccacggtccgacccgggtccctcccgtacgaaccctacgtcctccgtcggggccctccgacggcgtaggaagggacgnggtactagtaatttacttacgtgccgtagtctacaaattaacaaaacaaaacgtaaacgtaaaacgttaccggttagggggttaccgggttaccggggaccgggggaaaccgggtaaacccgtaaaacggtccggtaaaccccggttacccgtaaccggttaccgaaccggtacccgaacggtcccgtcccggacccccgttcggtacctacccttccggttcccgttaccccc

SEQ ID NO: 365824 - DNA, 551 bp, Homo sapiens
  misc_feature: GZ8MTXP02FZQLY.51.53.E09.1.454.CMB.2.raw
  modified_base (343)..(343): a, c, t, g, unknown or other
  modified_base (403)..(403): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctggtaccaacaactacccggacaaacgtccccaaactcatgatctttgagtcagtgagtcggccgcgaggggttctcatcgcttcnccccgctccaagtctggcagcacggcctcctgaccatctctgggctccagctgaggacgnggctgtattatactgccagctcaataataacaaaaccgagaaacctagtttgggacgttcgggcgggaccgggaacctaaaacgtcgtaacccgtccttaaacgcacgccgaacggcctcgcccctcggtccactccgtcttcccccg

SEQ ID NO: 365825 - DNA, 541 bp, Homo sapiens
  misc_feature: GZ8MTXP02JHUVU.51.53.E09.1.454.CMB.2.raw
  modified_base (446)..(446): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaacgtccccaaactcatgatcttgagtcagtgatcggcccgcaggggtttctcatcgcttctccccggctccaagtctggcagcacggcctccctgaccatctctgggctccaggctgaggacgaggctgattagttactgcagctcatataacaaacagaaacncgttagggtgttcggcgggccgggtaacaaacgtcgaccgtcctacgtcgacgccccgaagccgtacgccccgtcggtcaccgtctcgttacccc

SEQ ID NO: 365826 - DNA, 553 bp, Homo sapiens
  misc_feature: GZ8MTXP02HD2E5.51.53.E09.1.454.CMB.2.raw
  modified_base (273)..(273): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcaccatctcctgcactggaaccaccaatgacattggtacttataattctgtctctgtacacaatacccggnaagcccaaactcatgatctttgagtcagtgatcggcccgcgtaggggtttctcatcgcttctcccgctccaagtctggcagcacgcctcctgaccatctctgggctccgagctgagacgaggctgattatactgcagctcatataacaaactagaaactcgttaggtgtacggacgggaccgggaaccaaacgtcggacccgtaccgacggtaccaacggacccgtaacggccgttccggacccccgtacggttaccacccttcctaccggtttcccccc

SEQ ID NO: 365827 - DNA, 677 bp, Homo sapiens
  misc_feature: GZ8MTXP02IT1F9.51.53.E09.1.454.CMB.2.raw
  modified_base (263)..(263): a, c, t, g, unknown or other
  modified_base (272)..(272): a, c, t, g, unknown or other
  modified_base (327)..(327): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccacatgactattgtactataattctgtctctgtacaanaatacccgnaaacgtccccaaatcatgatcttgagtcagtgatcggacccgtgtaggggtttcncatcgcttctcccggctccaagtctgctagcacgcctcctgaccatctctgggctccgagctgaacggtacgagggtcttaggtatttaactacgttggtacctaggtaccttactaaattaacgtaaaacccaaaaacgtaacggtaaaaaccgttcggtttaacgggggttacggtttacccgggggaaccggggtacccgggggtaaaaccctaaaacggttaccggtaaacccccggtttaccgttaaaccggttaccgaaccggttaccccgaaacgggttcccgtacccgtcccccggttacggggtaccctaaccggttcccgtttaccggtttcccccccgg

SEQ ID NO: 365828 - DNA, 567 bp, Homo sapiens
  misc_feature: GZ8MTXP02HBX8Y.51.53.E09.1.454.CMB.2.raw
  modified_base (416)..(416): a, c, t, g, unknown or other
  modified_base (438)..(438): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaactaccccggcaaacgtccccaaactcatgatcttgagtcagtgatcggcccgcgtaggggttctcatcgtcttctccccggctccaacgtctcggcacgccgaccgcctccctcgaccactctcgtcggctccgagcgtgagacgngctgtattattactgtcagctnaactataaacaaaacaagaaactacgttgggtaggttcggcgggaccggacaaaccgtcgacccgtacttaccgcgtaccgaccgaacgccgtccgacccccgtcggcctacctccgtccgttcccccg

SEQ ID NO: 365829 - DNA, 559 bp, Homo sapiens
  misc_feature: GZ8MTXP02IUWTL.51.53.E09.1.454.CMB.2.raw
  modified_base (375)..(375): a, c, t, g, unknown or other
  modified_base (408)..(408): a, c, t, g, unknown or other
  modified_base (430)..(430): a, c, t, g, unknown or other
  modified_base (443)..(443): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccggcaaagtccccaaactcatgatcttgaggtcagtgatcggcccgcgtaggggtttctcatcgcttctcccgctccaagtctggcacgcacggcctcccncgacctatctctcgggctccgagctgaggacgnggctgattatactgcagcttanaatataaacaaanaacgtaactacgttaggtgtacggacggacggaacaaacgtcgtaccgtccgtacgtacgaaccgaccgacgtcccgtccgtaccccgtcgacctaccgtccgttacccgtccccg

SEQ ID NO: 365830 - DNA, 548 bp, Homo sapiens
  misc_feature: GZ8MTXP02I749V.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaacgtccccaaactcatgatcttgaggtcagtgatcggcccgcgaggggtttctcatcgcttctccccgctcaagtctggcagcaccggcctccctcgaccatctctgggacctccgaggctggaggacgaggctgtattatactgcagctacatactaacaaacaagaaaactcgttagggtcgttaccggcgggacggaaccaaacgtcgaccgtcctaacgtcacgccgaagcctaccgcccctcggcactcctcgttaccccc

SEQ ID NO: 365831 - DNA, 536 bp, Homo sapiens
  misc_feature: GZ8MTXP02FP99G.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtaccaacaataccccggcaaagtccccaaactcatgatctttgaggtcagtgatcggcccgcaggggtttctcatcgcttctcccgctccagtctgcagcacggcctcctgaccatctctgggctccgagctggagacgagctgtattatactgcagctacatataacaaacaagaaacacgttgggtgttacggcggacggaaccaaacgcgacccgtactacgtcgacgtcccgaaggcctaccggccccgtcggtacctactccgtcgtttccc

SEQ ID NO: 365832 - DNA, 562 bp, Homo sapiens
  misc_feature: GZ8MTXP02F79XA.51.53.E09.1.454.CMB.2.raw
  modified_base (373)..(373): a, c, t, g, unknown or other
  modified_base (406)..(406): a, c, t, g, unknown or other
  modified_base (452)..(452): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtacaacaatacccggcaagtccccaaactcatgatcttgagtcagtgatcggcccgctaggggtttctcatcgcttctccccgctccaagtctggcacgcaccgggcctcccncgaccatctcgtcgggcctccagctgaggacgnggctagtattatactgcagctcataactaacgaaaacagtaaaacncgtttagggtacgttcgggacgggacggggaaccaaaacgtcggacccgttaccgtacgtcgacgcccgaacggccgtaccgcccctcggtccaccgtctcgttaccccc

SEQ ID NO: 365833 - DNA, 577 bp, Homo sapiens
  misc_feature: GZ8MTXP02IK129.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgaaccacaatgactattgtacttataattctgtctctggtaccaacaactaccccggacaaacgtccccaaactcatgatctttgagtcagtgagtcggcccgtcgtaggggtttctcactcgcttctccccggctccaagtctgcagccgacgccctccctgacccatctcgtgggcctccgaggctggaggacgaggctagattatactgcagtctacaatactaacaaacaagtaaactgttacgggttgttcgggcggtacccggaacaaacgtcggacccgttaccgtacgtaccaccgtacccgaacggccgtccgacccccgtcggtacctcctccgttcgtttccccccg

SEQ ID NO: 365834 - DNA, 561 bp, Homo sapiens
  misc_feature: GZ8MTXP02FYRZG.51.53.E09.1.454.CMB.2.raw
  modified_base (305)..(305): a, c, t, g, unknown or other
  modified_base (426)..(426): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctaggtctcctggacagtcgatcaccatctcctgcactggaaccacaatgacattggtacttataattctgtctctgtacaacaatacccgcaagtcccaaactcatgatcttgagtcagtnatcggccgctacggggttctcatcgcttctcccgctccaagtctggcagcgacgcctccgtgaccatctcgtcgggctccgaggctggagacggagctagtacttattactgacacgctanataaactaacaaaacaagtaaaacctacggttgggttacgttaccggggcgggaccgggaacctaaacgtcgacccgtacctacgtcgaacgcccgaaagccgtaccgcccctcggtccactcctccgttccccc

SEQ ID NO: 365835 - DNA, 563 bp, Homo sapiens
  misc_feature: GZ8MTXP02JVDPN.51.53.E09.1.454.CMB.2.raw
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaataccccggacaaacgtccccaaactcatgatctttgagtcagtgatcggcccgcgtaggggtttctcatcgcttctccccggctccagtctggcagcaccggcctccctgaccatctctgggcctccgaggctgaggacgaggctagattagttactgcagctcaatataaacaaacgaacgaaactcgttagggtcggttcggacggaccgggtaaccaaaacgtcgaaccgtacctacgaccacgacccaacgcgtccgcccccgtcggtccacctccgtacgttccccc

SEQ ID NO: 365836 - DNA, 558 bp, Homo sapiens
  misc_feature: GZ8MTXP02GIMY4.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttatattctgtctctgtaccaacaataccccggcaaacgtcccaaactcatgatcttgagtcagtgatcggccgcaggggtttctcatcgcttctcccggctccagtctgcagcacggcctcctgaccatctctgggctccgagctggagacgaggctagtattattactgcagctacataataacaaacaagaaactacgttgggtacgttcggacgggtacgggaaacctaaaacgtcggacccggtacctacgtccgaacgacccgaaacggccgtccgccccctcggtccaccgttccgtccgtttcccccg

SEQ ID NO: 365837 - DNA, 546 bp, Homo sapiens
  misc_feature: GZ8MTXP02G2D5T.51.53.E09.1.454.CMB.2.raw
  modified_base (285)..(285): a, c, t, g, unknown or other
  modified_base (332)..(332): a, c, t, g, unknown or other
  modified_base (425)..(425): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttatattctgtctctgtacacaatacccgcaatcccaactcangatcttgagtcagtgatcggcccgcgtaggggtttctcatcgcttcnccccgctccagtctggcagcgaccggcctccctgaccatctcgtcgggcctcgacgctagaggacgaggctgtattatactgcagctcattanaacaaacagaactagtggtgttcggcggacggaacctaacgcgaccgtaccgtacgtaccgacggacccaacggtccgtccgacccccgttcggtcctaccctccgttcgtttaccccccc

SEQ ID NO: 365838 - DNA, 575 bp, Homo sapiens
  misc_feature: GZ8MTXP02JRHMU.51.53.E09.1.454.CMB.2.raw
  modified_base (340)..(340): a, c, t, g, unknown or other
  modified_base (437)..(437): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtaccaacaatacccggacaaagtaccccaaactcatgatcttgagtcagtgatcggccgcgaggggtttctcatcgctcncccggctccaagtctggcagcaccggcctccctgaccactctcgtcgggctccgaggctgaggacgaggctagtattatactgcagtctacattaanaaacaaaacgagaaacgtacgtttaggggtcggttcggacgggacgggtaacccaaaacggtcggtaccgtccgtaacgtccgaacgacccgaaggccgtcgacccccgtcggtcctacgtcccgtacgtttcccccg

SEQ ID NO: 365839 - DNA, 516 bp, Homo sapiens
  misc_feature: GZ8MTXP02I6F9O.51.53.E09.1.454.CMB.2.raw
  modified_base (286)..(286): a, c, t, g, unknown or other
  modified_base (331)..(331): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtacaacaatacccgcaaagtcccaaacncatgatcttgagtcagtgatcggccgcagggttctcatcgcttcnccggctccagtctggcagcacgcctccctgaccatctctgggctccgagctgaggacgagctgattatactgcagctcatataacaaacagaaactacgtgggtagttcggcggacgggaacaaacgtcgaccgtcctacgtcacgcccaaggcctcgccccgtcggtcacctctcgttaccccc

SEQ ID NO: 365840 - DNA, 555 bp, Homo sapiens
  misc_feature: GZ8MTXP02F8JFW.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctctgtacaacatacccgcaactcccaaactcatgatcttgaggtcagtgatcggcccgcaggggtttctcatcgcttctcccgctccagtctgcagcacggcctccctgaccctatctcgtgggctcccgaggctgaggacgaggctgtattatactgcagctcatataacaaacaagaaactacgttgggttcgttcgggcgggtaccggaaccaaaacgtcggacccgtaccgtaccgtcgaccgcccgaaaggtccgtaccgcccccgttacggccctactccttcgtttaccccc

SEQ ID NO: 365841 - DNA, 705 bp, Homo sapiens
  misc_feature: GZ8MTXP02HZMFL.51.53.E09.1.454.CMB.2.raw
  modified_base (327)..(327): a, c, t, g, unknown or other
  modified_base (339)..(339): a, c, t, g, unknown or other
  modified_base (417)..(417): a, c, t, g, unknown or other
  modified_base (454)..(454): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaaacaactaccccggacaaacgtccccaaactcatgatctttgagtcagtgatcggcccgngtaggggtttcnatcgcttcgtccccggctaccagtctggcagccaccggccctcccctagaccactctcgtcgggccctccgaggtccnggaacgggacggaggcctaggtaatttacgtttaacnggaccaggacctttaccaaattaacgtaaaaccaaaaacgtaaacgaaaaaccttaaccgggtttagggggttacgtttcccgggggaccggggtaacccggggtaaaacccaaaaaaccggttccggtaaaccccggttacccgttaaacccgggtaccaaacccggaccccgaaaacggggtccccttaccgggccccccccgttcgggtaacccctaccctttacccggttacccgtttacccccccg

SEQ ID NO: 365842 - DNA, 574 bp, Homo sapiens
  misc_feature: GZ8MTXP02GL9PZ.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaactaccccggacaaacgtccccaaactcatgatcttgagtcagtgactcggccgcgtaggggtttctcatcgcttctcccggctccagtctggcagcacggcctccctgaccatctcgtcgggctccgagctaggaggacgaggctgtaattagtactgcagctcatataacaaaacagaaactcgttagggtcgttcgggacggaccgggtaaccaaaacgtcgaacccgttaccgtaccgtacaccgacccgaacggccgtcccgccccgtaccggtccaccgttccgttccgttccccccg

SEQ ID NO: 365843 - DNA, 550 bp, Homo sapiens
  misc_feature: GZ8MTXP02HDLEO.51.53.E09.1.454.CMB.2.raw
  modified_base (342)..(342): a, c, t, g, unknown or other
  modified_base (391)..(391): a, c, t, g, unknown or other
  modified_base (394)..(394): a, c, t, g, unknown or other
  modified_base (402)..(402): a, c, t, g, unknown or other
  modified_base (404)..(404): a, c, t, g, unknown or other
  modified_base (413)..(414): a, c, t, g, unknown or other
  modified_base (416)..(416): a, c, t, g, unknown or other
  modified_base (419)..(419): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccacaatgacattggtacttataattctgtctcctggtaccaacaataccccggcaaacgtccccaaactcatgatctttgaggtcagtgatcggccgcaggggtttctcatcgcttcncccggctccagtctgcagcacggcctccctgaccatctctggctaccgngcngagagagntntatatactnnanctnataacaacaaacaaacgaaactacgtaggtaggtcggacggacggaaccgaaacgtacgtaccgtaccgtaccgtacgacgaccgacgaacgccgacccgtacccgtaccgtacctaccgttaccgtcccg

SEQ ID NO: 365844 - DNA, 550 bp, Homo sapiens
  misc_feature: GZ8MTXP02IQH1B.51.53.E09.1.454.CMB.2.raw
  modified_base (333)..(333): a, c, t, g, unknown or other
  modified_base (374)..(374): a, c, t, g, unknown or other
  modified_base (380)..(380): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtaccaacaactaccccgacaaacgtccccaaactcatagattcttgagtcagtgatcggccgcgtagggtttcncatcgcttcgcccgctcagtctgcagcacgcctcctgaccntctcgnggctcgagcagagcgaggctagattatactgcagctcaataactaacaaaacagaaacgtcgttgggtcgtacgggcggacggaacaaacgtcgaaccgtccgtacgtccgacgcccaacgggtcctacccgcccccgttcggcctacccgttcctacccggttcccccg

SEQ ID NO: 365845 - DNA, 562 bp, Homo sapiens
  misc_feature: GZ8MTXP02I4D5G.51.53.E09.1.454.CMB.2.raw
  modified_base (321)..(321): a, c, t, g, unknown or other
  modified_base (374)..(374): a, c, t, g, unknown or other
  modified_base (436)..(436): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaatacccgacaaacgtccccaaactcatgatcttgagtcagtgatcggcccgngtagggttctcatcgtcttctcccgctccaagtctggcagccacggcctcccngaccatctcgtcgggcctccgaggctaggaggacgaggctagtattattactgacagtctanattaacaaacaaaacgagaaaactcgttagggtcgttcgggcggacggaaaccaacgtcgaccgtacctacgtacacgacccgaacgcgtaccgcccccgtcggtcctacctctccgtttcccccg

SEQ ID NO: 365846 - DNA, 669 bp, Homo sapiens
  misc_feature: GZ8MTXP02HS1T2.51.53.E09.1.454.CMB.2.raw
  modified_base (282)..(282): a, c, t, g, unknown or other
  modified_base (324)..(324): a, c, t, g, unknown or other
  modified_base (334)..(334): a, c, t, g, unknown or other
  modified_base (344)..(344): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgactattggtacttataattctgtctcctggtaccaaacaactaccccgganaaacgtccccaaatcatgatctttgagtcagtgatcggccgngagggtttcncatcgcttcnccccggtctaccgagtctggcacgccaccgggcctcccgtcgaccactcctcgtcggcctaccgagggtcctagggaacgggtacggacggcttaggtaatttacgtactcgcgtacgtcttacaaatactaaaacaaaacgtaacgtaaacgtaacggtttcggggtacggttcggggacccggggaaccgggtaaacctaaaacgttcggaccccgttaccgtaccggtaccgaacccgtaacccgtaaaccgggtcccgtcccggtcccccccggttacggtaacccgttccctaacccggttttcccgttaaccccccccg

SEQ ID NO: 365847 - DNA, 557 bp, Homo sapiens
  misc_feature: GZ8MTXP02GKRCG.51.53.E09.1.454.CMB.2.raw
  modified_base (274)..(274): a, c, t, g, unknown or other
  modified_base (295)..(295): a, c, t, g, unknown or other
  modified_base (437)..(437): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccacaatgactattggtacttatattctgtctctgtacaacactacccganaactccaactcatgatcttgngtcagtgagtcggccgcgtaggggtttctcatccgtcttctaccccggtctaccagtctggcacgccgacggccctccctcgacctactctcgtcggctccgaggctggagacgaggtctagtatttatactgctagtctanaatactaacaaacagtaactacgttgggcgttcggacggtacggaaccaacgtcgaccgtacgacgtccacgaccgaaggtccgaccgtcccgtcggtcctacttccgtccgttcccccg

SEQ ID NO: 365848 - DNA, 518 bp, Homo sapiens
  misc_feature: GZ8MTXP02G7PPL.51.53.E09.1.454.CMB.2.raw
  modified_base (317)..(317): a, c, t, g, unknown or other
  modified_base (326)..(326): a, c, t, g, unknown or other
  modified_base (336)..(336): a, c, t, g, unknown or other
  modified_base (422)..(422): a, c, t, g, unknown or other
  modified_base (426)..(426): a, c, t, g, unknown or other
  modified_base (430)..(430): a, c, t, g, unknown or other
  modified_base (437)..(437): a, c, t, g, unknown or other
  modified_base (439)..(439): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaataccccggacaaaacgtccccaaaactcatgatcttgagtcagtnatcggccgngagggtttcncatcgcttctcccgctccaagtctggcagcacggcctcctgaccatctctgggctccagctgaggacgaggctgattatactgcanctanatanaacaaananaacagtggtgtcggcggacggaacgaacgacgacgtactacgtacacgaccgacgcgcgcccgtcgtcactctcgtccg

SEQ ID NO: 365849 - DNA, 645 bp, Homo sapiens
  misc_feature: GZ8MTXP02JGIDF.51.53.E09.1.454.CMB.2.raw
  modified_base (171)..(171): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgctaaacngcctgcctccgtgtctgggtctcctggacagtcgatcaccatctcctgcactggaaccacaatgacattggtacttataattctgtctctggtaccaacaactacccggcaaacgtccccaaactcatgatcttgagtcagtgatcggcccgcgtacggggtttctcatcgtcttccgtccccggctccaacgtcgtggcacgccgaccggcctccctcgacctatcctcgtcgggcctccgaggtctggacggacgaggctagtattatacgtgtacagctacataactaaacaaaacgaacgtaaaacgtacggtttggggtacggttccggggacgggaccggggtaaacctaaaccgtaccggtaaccccggttaccgtaaccggtccgaaccggaccccgaaaacggtcccgtacccggtcccccgttaccgggtacctaccgtttcccgttcccggtttacccccccg

SEQ ID NO: 365850 - DNA, 843 bp, Homo sapiens
  misc_feature: GZ8MTXP02H7JOV.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctctgacagtcgatcaccatcctctgcactgaaccacaatgactattggtacttataattctgtctcctggtaccaacaactaccccggacaaacgtacccccaaactcaatgtattctttaggaggtcaggtgacgtccgggccccgtagttacggggtttctcgtacttccgtcctttccgtcccccgggaccttacccgtaaacgttccgttacgggaccgaaccgggcccgtaaaccccgggggttcccccttacccccgttaccgtaaccccctaacgtttcccttccgtccgggggtacccttccccggaacggggtccggttacgggacggggaacgggtacgggtaccgttaggtaacttttacgttaacgtacggtcgtaacggtacttaactaactaaacttaaaacaaaaaccgtaaacgtaaaaccgttacgggtttacgggggtttacgggttacccgggggtacccgggggtaacccggggtaaaacccgtaaaacggttacccgggtaaaccccggttaaccccggttaaccggtacccgtaacccggaccccggtaaaaccggtcccgtaccccggtacccccccggttcgggttaacccctaccccgtttacccgtttcccccggtttccccccccgg

SEQ ID NO: 365851 - DNA, 540 bp, Homo sapiens
  misc_feature: GZ8MTXP02JA2CO.51.53.E09.1.454.CMB.2.raw
  modified_base (275)..(275): a, c, t, g, unknown or other
  modified_base (320)..(320): a, c, t, g, unknown or other
  modified_base (344)..(344): a, c, t, g, unknown or other
  modified_base (428)..(428): a, c, t, g, unknown or other
  modified_base (435)..(435): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccacaatgacattggtacttataattctgtctctggtaccaacactacccgnaaagtccccaaactcatgatcttgaggtcagtgactcggccccgngtaggggtttctcatccgctttcnccccggctccaagtctggcagcacggccctccctgccatctcgtcgggctccgaggctaggacggacgaggctgagttattacngcagctnatataacaaacagaaactacgtgggtgttcggcggacggaaccaactcgaccgtcgtacgcacgcccgaagccgtacgcccctcggtaccacgtctcgtaccccc

SEQ ID NO: 365852 - DNA, 608 bp, Homo sapiens
  misc_feature: GZ8MTXP02HNCIA.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgactattgtacttatattctgtctctggtaccaacaactaccccggacaaacgtccccaaactcatgatctttgagtcagtgatcggcccgcgtaggggtttctcactcgcttctccccggctaccagtctggcagccgacggccctccctgaccctatctcgtcggactccgagctggacgtacgaggtctagtaattacttactgtcaagtctacaattaacaaacaaaacgaaacgaaaactcggtttaggggttcggttaccgggcgggaaccggggaacctaaacggttcgaacccgtcgtaaccgtcgaaccgcccgaaacggtccgtacccgtcccccgtcggtacctacccgttccgtttaccttcccccc

SEQ ID NO: 365853 - DNA, 552 bp, Homo sapiens
  misc_feature: GZ8MTXP02JDQX1.51.53.E09.1.454.CMB.2.raw
  modified_base (377)..(377): a, c, t, g, unknown or other
  modified_base (396)..(396): a, c, t, g, unknown or other
  modified_base (443)..(443): a, c, t, g, unknown or other
  modified_base (450)..(450): a, c, t, g, unknown or other
tcagcgatcgtatacacgaccggtgctcgatttagagagagtgtgttgggtttgggggtctcaggaggcagcgctctcgggacgtctccaccatggcctgggctctgctattcctcaccctcctcactcagggcacagggtcctgggcccagtctgccctgactcagcctgccctccgtgtctggggtctcctggacagtcgatcaccatctcctgcactggaaccacaatgacattggtacttataattctgtctcctggtaccaacaatacccgcaaagtcccaactcatgatcttgagtcagtgatcggcccgcaggggtttctcatcgcttctcccggctccaagtcctggcagctacgcctccctgacatcnctgggctccgagctgacgngaggctgatatactgcagctcatatacaaaacagaaacacttagggngttcggngacggggaccaaacgtagacccggtacaaccggttcacggacccaaagggcctacggaccccccgtttacgggaccctaccgttccttccggtttccccccg

SEQ ID NO: 365854 - DNA, 541 bp, Homo sapiens
  misc_feature: GZ8MTXP02FHYRC.51.53.E09.1.454.CMB.2.raw
  modified_base (342)..(342): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttcncccggctccagtctggcagcacggcctcctgaccatctctgggctcccaggctgaggacgaggctgattattactgcagctcatatacaaacagaaaacacttagggtgttcgggcggacggggaccaaaacgtgaaccgtccctacgtccacgcccaaacggcctcgcccccctcggtcccactcctcgtttcccccc

SEQ ID NO: 365855 - DNA, 708 bp, Homo sapiens
  misc_feature: GZ8MTXP02HPNTU.51.53.E09.1.454.CMB.2.raw
  modified_base (297)..(297): a, c, t, g, unknown or other
  modified_base (308)..(308): a, c, t, g, unknown or other
  modified_base (324)..(324): a, c, t, g, unknown or other
  modified_base (432)..(432): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtcggaaaccacaatgactagttgtacttataattctgtctctagtacaacaactacccgacaacgacccaaactcatnattcttgagtnagtgacgtccggccgngtacgggttctacgacgttccgtccttccgtccccgtcctaccgtaacgtcgtcggaccgacgccgtaccgtccctccgtacgacctactcgtcgtcggcctaccggnggaccgtggacgggacgtacgtcgtaacgttatttacgtacgtcgacgtagtaccttaataactaaactaaaaccgaaaacgtaaacgtaaacccgttacgggtttacggggttacgggttccggggaaaccggggtacccggggtaaaaccttaaaaccgggttcccgggtaaaccccgttaccggtaaccggtaaccgaccggtaaccccgtaacggtcccgtaccccgtccccggttacggtccctaacccgtttcccgttacccttcccccg

SEQ ID NO: 365856 - DNA, 697 bp, Homo sapiens
  misc_feature: GZ8MTXP02JQOOH.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgactattggtacttataattctgtctctgtaccaacactacccgacaaacacccaactcatgatcttgaggtcagtgactccggccgcgtacggggtttctcgatccgtcttccgccccggtctaccgtaagtcgtcggcaacgccgaccggtccctacccgtacgaccctacgtcctcggtcgggtcctaccggacggcctagggaacgggtacgaggggtctagtaatttactacgtacgcgtaactcctaataactaaactaaaacaaaaccgtaacgtaaaaccgtgggtttacgggggttggttacccgggggtacggggacccgggtaaaaccgtaaaaccggttccggtaaacccggttaccgttaaccggtaccgaaccgggtaaccccgaacggggtccctaacccggtcccccgttacgggtaccctaccgtttcccggttccctttccccccgg

SEQ ID NO: 365857 - DNA, 545 bp, Homo sapiens
  misc_feature: GZ8MTXP02IRX6P.51.53.E09.1.454.CMB.2.raw
  modified_base (330)..(330): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccacaatgacattgtacttataattctgtctctgtacaacaataccccggcaaacgtccccaaactcatgattcttgagtcagtgatcggcccgcgtaggggtttcncatcgcttcctcccggctccaagtctgcacgcgaccggccctccctacgacctatcctcgtcgggcctccgagctggaggacgacggctagtattatactgcacgctcattactaaacaaacgagaaactcgttaggtgttacggacggacggaaccaacgtcgaccgtactacgtcaacgccaacgctaccgcccgtcgctactctcgtccccg

SEQ ID NO: 365858 - DNA, 727 bp, Homo sapiens
  misc_feature: GZ8MTXP02HVYWF.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactgaaccacaatgactattggtacttataattctgtctctggtaccaacaactaccccggactaaacgtccccaaactcatgatcttgagtcagtgacgtccggccgtcgtagggtttctacgactccgtcttccgtccccggctaccgtaacgtcgtggccagccgaaccggtccctcccgtacgacctatccttcgtcgggtcctccgaggtcctaggaacggaacggacggtacgttagtaactttacttaaccgtaggtcctaggtacttaaccgtaaagtttaaactaaaacccaaaacggtaaacgtaaaaccgtacggttttacgggggtacgtttaaccgggggaacccggggaaccggggtaaaaccctaaaaaccggttccgggtaacccgttaaccccggttaaacggttaccgaaacccggtaccccgtaaaagggcccgttaccccgcccccgttacggtaccctaacccgtttcgtttaaccccggtttaccccccg

SEQ ID NO: 365859 - DNA, 719 bp, Homo sapiens
  misc_feature: GZ8MTXP02H6SRL.51.53.E09.1.454.CMB.2.raw
  modified_base (335)..(335): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccacaatgactattggtacttataattctgtctctgtaccaacaactacccggacaaacgtccccaaactcatgatctttgagtcagtgactcggccgtcgtaggggtttcncatcgcttcctccccggctaccgaagtctggcacgccgaccggtccctcccgtagaccctactctccgtcgggtcctcccgaggtcgtacggaacgggacggtacgggtctaggtaactttacttaccgttagacgtaacggtaccttactaaacttaaacgtaaaaccaaaaaccgtaaacgtaaaaccggttacggtttacgggggttaccggtttaccgggggtaccgggggaaccccggggtaaaccgtaaaaccggttccggtaaaccccggttacccgttaacccggttaccgaacccggacccgtaaaccgggtcccgttacccggtccccccggttacggtccctaacccgtttaccgttccccgtttaccccccg

SEQ ID NO: 365860 - DNA, 556 bp, Homo sapiens
  misc_feature: GZ8MTXP02GQN7Z.51.53.E09.1.454.CMB.2.raw
  modified_base (434)..(434): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccacaatgacattggacttataattctgtctcctggtaccaacgactaccccggacaaacgtccccaaactcatgatcttgagtcagtgatcggccgcaggggtttctcatcgcttctccccggctccaagtctggcagcacggcctccctgaccatctctcgggctcccagctgaggacgaggctgacttatactgcagctcataaanaacaaacaacgaaactacgttgggtcggtcgggacggacggaacctaaacgtacgaacccgtaccgtacgtacaccgacccgaacgccgtcccgccccgtcgtacctacctcctaccgtccc

SEQ ID NO: 365861 - DNA, 568 bp, Homo sapiens
  misc_feature: GZ8MTXP02F69ZP.51.53.E09.1.454.CMB.2.raw
  modified_base (413)..(413): a, c, t, g, unknown or other
  modified_base (436)..(436): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacatgacattgtacttataattctgtctctgtacaacaactacccgacaacgtacccaactcatgatcttgagtcagtgagtccggccgcgtagggtttctcatcgtcttccgtccccggctccgaagtccgtggcacgccgaccggcctccctcgacctatctcgtcgggctccgagctggaggacgngctagtattatactgcagtctanattaacaaacaaacgagaaactcgttagggtgttccgggacggtacgggaacaaaacgtcgacccgtacgtacgtccgacgcccaagggccctaccgcccccgttcggcctaccgtccttccgtttcccccg

SEQ ID NO: 365862 - DNA, 736 bp, Homo sapiens
  misc_feature: GZ8MTXP02HD2HZ.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactcggaaccacaatgacattgtacttataattctgtctctagtaccaacaactaccccggacaaacgtaccccaaactcatgattcttgagtcagtgacgtccggcccgtacgtacggggtttctacgagttccgtccgtttccgtcccccgggtacctacccgtaaacggtccgtacggggaccaacgcccgtaacccgggtccctacccgtacgaccctactccgttcgtcggggtccctccgaacggtcgtaggaacgggacggtacggcttacgtaatttactacgtcgactcgcttacaactaagtaaaccaaaacgtaacgaaaccgttcgggttaggggttaccggttacggggacccggggaaccgggtaaaacccgaacggttccggtaaccccgttaccgttaacccggtacgaaacccgggtaccccgaaaaccgggtcccgtaaccccgggccccccgtttacgggtacccctacccggtttcccgtttaccccggttcccccccg

SEQ ID NO: 365863 - DNA, 700 bp, Homo sapiens
  misc_feature: GZ8MTXP02I6DM5.51.53.E09.1.454.CMB.2.raw
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactgaaccacaatgactattgtacttatattctgtctctagtaaccaacaactacccgacaaacgtaccccaaactcatgattcttaggacggtcaggtgacgtccggcccgtacggttacggggtttcctacgtacgttccgtccgtttccgtcccccggtaccttaccgtaagtccgtcgggacacggccgacccggtccctacccgtacgacctactccgtcgtcgggtcctaccgagtcgtaggacggacgacggtactagtaacgttacttaacgtcgacgtacgtacttacaaacttaacgaaaacccaaaagtaaacgtaaacccgttagggtttcggggttacgttaccggggaccgggaaaccggtaaacccgtaaacggttaccggaacccgttaccgtaaccgtaccgaaccgaacccgtaacggtcccgtacccgacccccgtcggttaccaccgtttccgtccgtttaccccc

SEQ ID NO: 365864 - DNA, 605 bp, Homo sapiens
  misc_feature: GZ8MTXP02HN7R2.51.53.E09.1.454.CMB.2.raw
  modified_base (305)..(305): a, c, t, g, unknown or other
  modified_base (329)..(329): a, c, t, g, unknown or other
  modified_base (353)..(353): a, c, t, g, unknown or other
  modified_base (356)..(356): a, c, t, g, unknown or other
  modified_base (588)..(588): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactgaaccacatgacattggtacttataattctgtctctgtaccaacaactaccccggacaaacgtaccccaaactcatgatcttgagtnagtgatcggccgcgtagggtttcncatcgcttctccccgctccagtcngcncgccacgccctcctcgacctacttctcgtcgggcctaccgagtcgaggacgggacgaggtctagtatttacgtctagcacgtactctaattaaacaacaaaacgtaacgaaaacgtacggtttacggggttcggttaccggggaccgggaccggggtaaaaccctaaacggtccgaccgtaccgtaccgtaccgacgtacccgacgtaaccgcccgtaccccgtcggtaccnccgttccttactccccc

SEQ ID NO: 365865 - DNA, 571 bp, Homo sapiens
  misc_feature: GZ8MTXP02JD1KV.51.53.E09.1.454.CMB.2.raw
  modified_base (389)..(389): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctggtaccacaactacccggcaaacgtccccaaactcatgatcttgagtcagtgatcggcccgcgtaggggtttctcatccgcttcctcccggcctccaagtctcggcagccacggccctcccgtgaaccctntcctcgcgggtctccgaggcgtgagacgaggctgacttatactgacagctcatataaacaaacagaaactagttacgggtggttcggcgggacggaacgaaaccttcggacccgttacgacgtccgacgacccgaaaggccgtaccgccccgtaccggtactaccggtccgttcttaccccc

SEQ ID NO: 365866 - DNA, 560 bp, Homo sapiens
  misc_feature: GZ8MTXP02JGGBW.51.53.E09.1.454.CMB.2.raw
  modified_base (355)..(355): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgacattggtacttataattctgtctcctgtaccaacaactacccggcaaacgtacccaaactcatgatcttgagtcagtgatcggcccgcgtaggggtttctcatcgcttctcccgctaccagtcnggcagcgaccggcctcctcgaccatctcgtcgggtcctccgacggcgtgaagggacgaggtctgtattattactgcagtctacaataactaacaaacaagaactacgttgggtagttggcggacggaaccaaacgtcgaaccctctaccgacaccgacccaaggcctccgtaccccgtcggtacctaccttcgtccgttcccccg

SEQ ID NO: 365867 - DNA, 578 bp, Homo sapiens
  misc_feature: GZ8MTXP02I6A3N.51.53.E09.1.454.CMB.2.raw
  modified_base (407)..(407): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccaccaatgacattggtacttataattctgtctcctgtaccaacaactacccggacaaacgtccccaaactcatgattctttgagtcagtgatcggcccgcgtaggggtttctcatccgtcttccgtccccggctaccagtctgcacgccgacggccctcctcgaccactctcgtcggctcgngctagagacgagctagtattatactgacagtctacaattacaaacaaacaacgaaactgttcgggtgtacgggacggaccgggaaactaaacgcgtacccgtaccgttacgaccacgacccgtaagcccgtacccgccccgttcggaccctcgttcccgtccgttcccccg

SEQ ID NO: 365868 - DNA, 732 bp, Homo sapiens
  misc_feature: GZ8MTXP02JFJR5.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccacaatgactattggtacttataattctgtctctggtaccaacaactacccggcaaacgtccccaaactcatgatcttgaggtcagtgactcggcccgcgtacggggtttctcgatcgcttcctcccggctaccaagtctcggcagccgaccggtcctccctgacctatcctcgtcgggcctccgaggtcgtaggaacgggcgaacggtctaggtacttacttaacgtcggactacggtacttacgtaaacttaactaaaaccgtaaaaccgaaacggtaaaaccgttacgggttttacgggggttacggggtttaacccgggggacccgggggtaaacccggggtaaaaccccgttaaaacgggttaacccgggtaacccccgggttaacccttaaacccgggttaccgaaaacccggttacccggaaaaccgggttcccgtaccccgggttccccccgtacgggttacccctaaccgtttcccgtttccccggtttacccccccgg

SEQ ID NO: 365869 - DNA, 542 bp, Homo sapiens
  misc_feature: GZ8MTXP02G0S8U.51.53.E09.1.454.CMB.2.raw
  modified_base (457)..(457): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctgtaccaacaactaccccggacaaacgtccccaaactcatgatcttgagtcagtgatcggcccgcgtaggggtttctcgtatccgtcttctccccggctccaagtctggcagcgaccggtcctcccgtacgaccactcgtccgtcgggtcctccgagccgtggaggacgcggctgtattatactgcagctacatacaanaaacagaaactgttagggtgtcggcggacggaccaacgtcgaccgtctacgcacgccaagcctcgcccctcgcactcgtctcccc

SEQ ID NO: 365870 - DNA, 625 bp, Homo sapiens
  misc_feature: GZ8MTXP02FVHFH.51.53.E09.1.454.CMB.2.raw
  modified_base (325)..(325): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatccaccatctcctgcactcggaaccacaatgactattgtacttatattctgtctctgtaccaacaactacccgacaaacgtacccaaactcatgattcttgaggtcagtgactccggcccgngtaggggtttctcactcgtcttccgccccggtctaccgaagtcgtggccaacgtccgaaccggtccctcccgtacgacctatcctcgtggcctaccgacgcgtaggaaggacggagtctagtattaactcgtacgactgtactactaataactaaacaaaacgaagaaacgttacgttacggggttcggttcgggacgggacggaaaccctaaaagtccggtacccgtaccgtacgtaccgaccgtaccgaaacgtccgtacccgccccgttcggtacctcgtccgttcgtttccccccg

SEQ ID NO: 365871 - DNA, 547 bp, Homo sapiens
  misc_feature: GZ8MTXP02FGE9C.51.53.E09.1.454.CMB.2.raw
  modified_base (309)..(309): a, c, t, g, unknown or other
  modified_base (520)..(520): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccacaatgacattggtacttataattctgtctcctggtaccaacaataccccggcaaacgtccccaaaactccatgatctttgngtcagtgatcggcccgcaggggtttctcatgccttctccccggctccaagtctggcagccacggcctcctgaccatctctcgggctccgagctgaggacgaggctgtattacgttatgcagctcataactaacaaacaagaaactaacgttgggtagttcggcgggaccgggaacaaaacgtgaacccgtctaacgtcacgcccgaaggcncgccccgtcgcctactctcgttccccc

SEQ ID NO: 365872 - DNA, 574 bp, Homo sapiens
  misc_feature: GZ8MTXP02GV01H.51.53.E09.1.454.CMB.2.raw
  modified_base (349)..(349): a, c, t, g, unknown or other
  modified_base (450)..(450): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccacaatgacattggtacttataattctgtctctgtaccaacaactaccccggacaaacgtccccaaaactcatgatctttgaggtcagtgatccggcccgcgtaggggtttctcatcgcttcnccccggctccaagtctggcagcaccggcctcctgaccatctctcgggctccgagctggaggacgaggtctagtattacttacgtgacagcttacaattaanaaacaaaacaagaaaactacgttagggtcgttacggggacggtaccgggaaaccaaacgtcggacccgtaccgtaacgtcgaacgccctaaggcctcgcccccgtcgactacctctcgtccccc

SEQ ID NO: 365873 - DNA, 666 bp, Homo sapiens
  misc_feature: GZ8MTXP02INZ70.51.53.E09.1.454.CMB.2.raw
  modified_base (293)..(293): a, c, t, g, unknown or other
  modified_base (323)..(323): a, c, t, g, unknown or other
  modified_base (336)..(336): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgactattggtacttataattctgtctctgtaccacaactacccgacaaactccccaaacncatgtattcttgagtcagtgatcggcccgngtacggggtttcncactcgcttccgtccccggctccgtaagtcgtggcacgccgaccggtccctccctcgacctatcctcgtcggggcctaccgaggccgtggacggaacgtagggtactagtaatttactacgtgacagtactactataactaaacaaaacgtaacgtaaaaccgtacggtttggggttcggttaccggggccggggtaaccgggtaaacccgtaaacgtaccggtaccgttaacccgtaaccgtaccgaaacccggtacccaaacggtccgtcccccggtcccccggtttacccggtactaccccgtttccgttaccccggtttacccccc

SEQ ID NO: 365874 - DNA, 646 bp, Homo sapiens
  misc_feature: GZ8MTXP02G5YPI.51.53.E09.1.454.CMB.2.raw
  modified_base (349)..(349): a, c, t, g, unknown or other
  modified_base (451)..(451): a, c, t, g, unknown or other
  modified_base (459)..(459): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgactattggtacttataattctgtctctagtaccaacaactaccccggacaaacgtaccccaaactcatgatcttgagtcagtgacgtccggccgcgtaggggtttctcactcgcttcnccccggtctccaagtctggccagccgaccggccctcccgtacgacctatctcgtgggcctcgagcgtggaaggacgagctagtattatacgtgctagactanaacttaanaaaacaaaacgaaacgtaaaacgtacggttgggttacggttacgggaccggggaaccggtaaacctaaaccggtacgtaacccgttaccgttaacgaccgtaaaccgacccgtaaacggggtcctccccggttaccccccggtacgggtaccctacccgtttcccgtttaccccgggtttccccccg

SEQ ID NO: 365875 - DNA, 564 bp, Homo sapiens
  misc_feature: GZ8MTXP02GLW45.51.53.E09.1.454.CMB.2.raw
  modified_base (318)..(318): a, c, t, g, unknown or other
  modified_base (334)..(334): a, c, t, g, unknown or other
  modified_base (339)..(339): a, c, t, g, unknown or other
  modified_base (358)..(358): a, c, t, g, unknown or other
  modified_base (439)..(439): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacatgacattgtacttatattctgtctctgtaccaacaataccccggacaaacgtaccccaaactcactgatcttgagtcagtgagtcggccgntaggggtttctcatcncttcncccggctaccaagtctgcngcgaccgcctcctgaccatctcgtggcctcgagctgaggacgagctgtattatactgcaagctacatacaaacaaaccganaaaccgtagttcgggtcgttacgggacggacggaaccgaaacgtacgtacccgttaccgtacgaccgacgacccgtaaggcctccgtacccccgtacggtcctacctccgttcgtttaccccccg

SEQ ID NO: 365876 - DNA, 599 bp, Homo sapiens
  misc_feature: GZ8MTXP02F9YD1.51.53.E09.1.454.CMB.2.raw
  modified_base (349)..(349): a, c, t, g, unknown or other
  modified_base (363)..(363): a, c, t, g, unknown or other
  modified_base (379)..(379): a, c, t, g, unknown or other
  modified_base (382)..(382): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctctgtaccaacaactacccggcaaactccccaaactcatagatctttagaggtcaggtcgagtcggcccgcgtaggggtttctcatcgcttcncccgctcatctgcngcacgcctcctgaccntcncgtcggctccgagctgacggagagtctgtattactgtgcagtactcaattaactaaaacaaacgaagtaaactacggttgggtcgttcggggacgggaaccgggtaaccaaaacttcgggaccccgtaccgtaccgtacgacccggacccgaaacggtcccgtcccggtaaccccccgttcgggtaacctcccttcccggtcccgttttaccccccg

SEQ ID NO: 365877 - DNA, 588 bp, Homo sapiens
  misc_feature: GZ8MTXP02GN5BW.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctgtaccaacaactaccccggacaaacgtccccaaactcatgatctttgagtcagtgatccggcccgtcgtaggggtttctcgatccgtcttcgtccccggtctccaagtctgcagccaccggcctccctgaccactctcgtcgggcctcccgaggctaggaggtacgaggtctgtattactactgacagtctacatactaacaaaacgaagaaactacgttagggtcgttcgggacggtaccgtaaccaaacgtcgtacccgtacgtacgtacgacgacccgaacggcctaccgcccccgttcgtaccacgttcctacgtttcccccc

SEQ ID NO: 365878 - DNA, 639 bp, Homo sapiens
  misc_feature: GZ8MTXP02GF451.51.53.E09.1.454.CMB.2.raw
  modified_base (308)..(308): a, c, t, g, unknown or other
  modified_base (350)..(350): a, c, t, g, unknown or other
  modified_base (423)..(423): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcgagggcacgagggtcctgggcccagtctgccctgactcagcctgcctccgtgtctgggtctccgtggacagtcgatcaccatcctctgccatacggaaccacaatgactagttgtacttatacttctgtctcctggtaaccaacaactacccggacaaacgtaccccaaactcatntatcttgagtacagtgacgtccggcccgtcgtacgggtttcncgtactcgtccttccgcccggtacctaccgaagtcgtcggcacgcccgaccggccctccacgcctagtctcgngacctcgaggcgtaggagacgtagcttagtattacgtacgtgacgatactacaataaactaaacaaacgaacgtaacgtacgggttcgggtacggtaccgggacgggaaccgaaaccgtaacgtaccggtacccgtaccttaccgaccgaccgtaccgaaccggtccgtaccccgcccgttacgtaccctaccgttcccgtaaccctttccccccg

SEQ ID NO: 365879 - DNA, 611 bp, Homo sapiens
  misc_feature: GZ8MTXP02IGJW5.51.53.E09.1.454.CMB.2.raw
  modified_base (255)..(255): a, c, t, g, unknown or other
  modified_base (340)..(340): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccaccaatgacattggtacttataattctntctctagtaccaacaactaccccggacaaacgtaccccaaactcatagattcttgaggtcagtgatcggcccgcgtagggtttcnctatcgcttctcccgctcagtctggcacgcgaccggccctcccgtgacccatccgtctcgggctccgagcgtaggacggacggagggctagtatttatactgtcgagtctactataataaaccaaaactacgaaactacggttggggtcgttcgggtaccgggtaccggggaaacctaaaacgtcggaacccgttcctaaaaccgttccaaccggcccgtaaacggccgtcccggcccccgttcggaccctccttccgtccgtttaccccc

SEQ ID NO: 365880 - DNA, 600 bp, Homo sapiens
  misc_feature: GZ8MTXP02IROWO.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctgtaccaacaataccccgacaaacgtaccccaaactcatgatcttgaggtcaagtgactcggcccgcgtaggggtttctcatccgcttctcccggtctaccaagtctggcacgcgaccggccctccctacgacctactcgtctcgggctccgacgcgtaggacggtacgacggtctagtattattacgtgcagtctacataataaaccgaaacaagaaacctagtttcgggtacggtttccggggacggaccggggtaaccaaccgtacgacccgtaccgtacgtacgaccgcccaacggccgtccgtccccgtccggtcctaccttccgtccgttaccccc

SEQ ID NO: 365881 - DNA, 777 bp, Homo sapiens
  misc_feature: GZ8MTXP02J1R9F.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccacaatgactattggtacttatattctgtctctgtaccaacaactaccccgacaaacgtccccaaactcatgatcttgagtcagtgagtccggcccgtcgtaggggtttcctcgtactccggtcctttccgtcccccgggtacctaccgtaaacgttcctgggcacggtccgaccgggtcccctcctgaacccattccgtcgtcggggtccctccgaggtccgtaggacgggacggacgggtacgttaggtaactttaacgtttaccgacggtcctacggtaccctttacaaactttaaacgtaaaaccctaaaaaccccgaaaaggtaaaaaccccgttacggggttttacgggggttaccgggtttaccggggaccccgggggaaccggggtaaaacccctaaaaccggtccgggaaaccccgttacccgttaaaccggtaccgaaccggtaaccccccggaaaaggtccccgtttaacccccgggaccccccgtttaccggggttaaccctaccccgtttcccggtttaacccgttttaccccccccg

SEQ ID NO: 365882 - DNA, 650 bp, Homo sapiens
  misc_feature: GZ8MTXP02FLCU7.51.53.E09.1.454.CMB.2.raw
  modified_base (319)..(319): a, c, t, g, unknown or other
  modified_base (330)..(330): a, c, t, g, unknown or other
  modified_base (340)..(340): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccacaatgacattggtacttataattctgtctctggtaccaacaactacccggcaaacgtccccaaatcatgatcttgagtcagtgatcggccncgtagggttcncatcgcttcnccccggctccgaagtcgtcggctagccgaccgggcccttcccgtacgtacctacttccgtcgtacggggcttcccggaagtcgtaggacgggacgacgcttagtaattactcgtagccaggtctacgaattacgtaaacaaacgtaagtaaacctgtttacgggcgttaccgggcgggtaaccggtaacccgaagttaccggtacccggttaccgtaaccgtccgaacggtaacccccgtaaaggtccccggttaccgtcccccggttacgggttaccctaacccgttccgttacccggtttaccccccg

SEQ ID NO: 365883 - DNA, 592 bp, Homo sapiens
  misc_feature: GZ8MTXP02GF1V9.51.53.E09.1.454.CMB.2.raw
  modified_base (341)..(341): a, c, t, g, unknown or other
  modified_base (421)..(421): a, c, t, g, unknown or other
  modified_base (425)..(425): a, c, t, g, unknown or other
  modified_base (429)..(429): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacatgacattggacttatattctgtctctgtaccaacaactacccgacaaacgtccccaaactcatgatcttgaggtcagtgactcggccgcgtaggggtttctcatcgcttccncccgctccaagtctggcacgcgacggccctcctcgacatctcgtcggctcgacggctgagacgagctagtattattacgngcanctanaataacaaacaaaacgaacgtaaacgtacggttcgggtacggtacgggacggaaccggtaaaccgtaaacgtaccgtaccgtaccgtaacgtaccgaaccgaccgtaacgtcccgtacccgtacccccgtaccgtacctacccgttccgttcccgttaccccg

SEQ ID NO: 365884 - DNA, 566 bp, Homo sapiens
  misc_feature: GZ8MTXP02I9UOA.51.53.E09.1.454.CMB.2.raw
  modified_base (351)..(351): a, c, t, g, unknown or other
  modified_base (446)..(446): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccacaatgacattggtacttataattctgtctcctggtaccaacaataccccggacaaacgtaccccaaactcactgatctttgaggtcagtgatcggccgcgtaggggtttctcactcgctttacncccggctccgaagtctgcagcgaccggcctccctacgacctactcctcgtcgggcctcccgaggcctggacgacggagctgattatatgcagctnatataacaaacagaaactacgtgggtagtcggcgggaacgggaccaaacgtcgaccgtacgtacgtcgaacgtcccaaaggcctccgacccccgtcgtaccaccttctaccgtttccccc

SEQ ID NO: 365885 - DNA, 771 bp, Homo sapiens
  misc_feature: GZ8MTXP02HRS47.51.53.E09.1.454.CMB.2.raw
  modified_base (341)..(341): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcacatctctgcactgaaccacaatgactattggtaacttataattctgtctctaggtaccaaactaactaccccgacaaacgtccccaaactcatgtatcttaggagtcagtgacgtcggcccgtcgtaggggtttcncgtatccgtcttccgccccggtctaccgaagtcgtgacgagcccgaccggtccctacccgtgaaccctactccttcccggcggggtcctacccggacggacggtacggacggggaacgggtacggtccgttaaaggtaaagttttacttaacgttcggtaccaaggtaccctaactaaatttaaacgaaaacctaaaaaccggaaaacgtaaaacccgttcggtttaccgggggttaagttcccgggggaaccggggttaaacccgggaaaacccggttaaaaccggaaccgggttaacccccggttaaacccgttaaaccgggtacccggaaacccgacccccggttaaaacgggcccccggttacccggaccccccggttcggttacccccgtaacccgtttcccctttaaccccggtttaccccccc

SEQ ID NO: 365886 - DNA, 791 bp, Homo sapiens
  misc_feature: GZ8MTXP02HNSVG.51.53.E09.1.454.CMB.2.raw
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgactattggtacttatattctgtctctgtacaacaactacccgacaaacgtacccaaactcatgatctttgagtcagtgagtccggccgcgtacggggtttctctacgttccgtcgttcctccccggtccttaccgtaacgttcgtcggaccgacggccgtaaccgggtccccttccccgtccgtaaccctaacttcgttcccggtcgggggtccttaccccggagggaccgttagggaacggggaaacccgggtaggggtaccctttaggtaaacttttaacgttaacgttcggaccgtaacggtactttaaccgaaaatttaaacgtaaaacccaaaaacgtaaacgggtaaaaccttacggggtttacgggggttacggttaccgggggacccggggaaccgggggtaaacccgtaaaaaccggttcggtaaacccccggttaccgtttaaacccggtaccgaaacccggaccccgaaacggggtccctcccccggtaccccccgttccggggttaaccctacccgtttacccggtttccccggttaacccccccg

SEQ ID NO: 365887 - DNA, 686 bp, Homo sapiens
  misc_feature: GZ8MTXP02IFAUD.51.53.E09.1.454.CMB.2.raw
  modified_base (229)..(229): a, c, t, g, unknown or other
  modified_base (335)..(335): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctgacagtcgatcaccatctcctgcactagaaccacangactattgtacttataattctgtctctgtaccaacaactacccggacaaacgtaccccaaactcatgattcttgagtcagtagatccggccgcggtacgggtttcnctactcgtctcgtccccgtctaccgtaagtcgtcggcacgtccgaccggtccctcccgtagaccctatctcgtcgggtcctccgaggcgtaggaacggacgtacggtcgttagtaatttacttacgtggacctacggacccttataacttaaacgaaaaccctaaaacgaaaacggtaaaccgttacggttttacgggggtacggttccggggaccggggtaacccggggtaaaacctaaacggtttccggaacccgtttacccgtaacggtacccgacggtacccccgaagggtcccttcccccggaccccgttacggtcccttaccggttcctttacccggttcccccc

SEQ ID NO: 365888 - DNA, 533 bp, Homo sapiens
  misc_feature: GZ8MTXP02F5ZMA.51.53.E09.1.454.CMB.2.raw
  modified_base (428)..(428): a, c, t, g, unknown or other
  modified_base (432)..(432): a, c, t, g, unknown or other
  modified_base (438)..(438): a, c, t, g, unknown or other
  modified_base (511)..(511): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaataccccggcaaacgtccccaaactcatgatcttgaggtcagtgatcggcccgcaggggtttctcgatcgcttctccccggtctccaagtctggcacgcacggcctccctgaccatctctcgggctccgagctgaggacgaggctgattattactgacngctnattaanaacaaacagaaacacgtagggtgttacgggcgacggaccaaacgtcgaccgtctacgtcacgccaagcgtccnccccgtcgcactctcttacccc

SEQ ID NO: 365889 - DNA, 685 bp, Homo sapiens
  misc_feature: GZ8MTXP02I7U9U.51.53.E09.1.454.CMB.2.raw
  modified_base (302)..(302): a, c, t, g, unknown or other
  modified_base (314)..(314): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatcctctgcactacggaaccacaatgactagttgtacttataattctgtctcctgtaacaacaactacccggacaaacgtacccaatcatntatctttgagtnatgactcggcccgtgtacgggttctcacgtcgtactttccgaccccggtcctaccgtaagttcgtacgccgtacgccgtaacccgggcccttaccccgtagaacccttcttccgttcgggttacgcccctacggtaacgggtcgtagggacggggaaaccgtgggtaccttaggttaacttacgtacgttacgcgtacgtctagtaaactaagtaaaaccaaacgtaacaaacggttcggttgggtaccggttacgggaccggtaaccggaacctaaacgtccgaaccgttaccgtacgaccgtaccggaccctaacgggcccgttacccgccccggttacgtaccctcgttcccgttacccttcccccgg

SEQ ID NO: 365890 - DNA, 664 bp, Homo sapiens
  misc_feature: GZ8MTXP02HS59D.51.53.E09.1.454.CMB.2.raw
  modified_base (328)..(328): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactgaaccacaatgactattgtacttatattctgtctctgacaacaactacccgacaaacgacccaactcatgtatcttgagtcagtgtacgtccggccgtgtacgggtttcncgtatccgtcttccgtccccggtctaccgtaagtcctggccagccgtaccggccctcccgtcgtacctactctcgcggtactccgagcgtaggacggtacgtacggtctagtaattacgttactggactagtcttaacaacgttaactaaaacaaaacgtaaagtaaaccgttacggttcggggtacggttaccgggacgggttaacccggaaaccgtaaacggtaccggtacccgttaaccgttaccgtaccgaaccgtacccgaacgggttcccgtaccccggtacccccgttcggtacccttaaccgttcccgtttacccgtttaaccccccg

SEQ ID NO: 365891 - DNA, 559 bp, Homo sapiens
  misc_feature: GZ8MTXP02JWQCB.51.53.E09.1.454.CMB.2.raw
  modified_base (324)..(324): a, c, t, g, unknown or other
  modified_base (347)..(347): a, c, t, g, unknown or other
  modified_base (414)..(414): a, c, t, g, unknown or other
  modified_base (430)..(430): a, c, t, g, unknown or other
  modified_base (436)..(436): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattggtacttataattctgtctcctggtaccaacaataccccggcaaacgtccccaaactcatgatcttgagtcagtgatcggcccgngtaggggtttctcatcgtcttcnccccggctcagtctggcagcaccgggcctccctgaccatctcgtgggcctcgaggctggacggacgnggctgtattatactgnagctanatataacaaacacgaaactacgttggtgttcgggcggacggaaccaacgtcgaccgtaccgtacgtcaccgaccgaacggtccgtccgtcccccgtcggtacctacttccgtcgttccccccg

SEQ ID NO: 365892 - DNA, 697 bp, Homo sapiens
  misc_feature: GZ8MTXP02IJ7F5.51.53.E09.1.454.CMB.2.raw
  modified_base (239)..(239): a, c, t, g, unknown or other
  modified_base (254)..(254): a, c, t, g, unknown or other
  modified_base (280)..(280): a, c, t, g, unknown or other
  modified_base (452)..(452): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctcgcctccgtgtctgggtctccgtggacagtcgatcaccatctcctgcactacgaaccacatgactnttgtacttatatctntctctagtaccaacaacgtacccganaaaccgtaccccaaactcatagtattcgttgagtcagtgagtccggccgtgtacggttcactacgtctcttccgtcccgtcctacgtagtcgtaggcaacgccgaccggtccctacccgtacgaccctatcctacggtcggcctaccgagggtctggaacggacgtacggtnttaggttaacttaacgtcgtacgaccgtacgtcttaactaaattaactaaaaccaaaacgtacgtaaaacgttcgggttacgggtacggttaccggggacgggtaacccggtaaaacctaacggtttacccgaccgtttaaacccgtaccggtccgaaaacccggtacccgtaacgggtccccgttaccccggtacccccgtttaccgtaccgtttaaccgtccccggtttcccgttaccccccg

SEQ ID NO: 365893 - DNA, 692 bp, Homo sapiens
  misc_feature: GZ8MTXP02IMTNM.51.53.E09.1.454.CMB.2.raw
  modified_base (384)..(384): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgactattgtacttataattctgtctctgtaccaacactacccgacaaactaccccaaactcatgtatcttagaggtctagtgagtcggcccgcgtaggggttctcatcgcttcgtcccgctccagtctggcagccgacgcctccctcgacctntctcgtcgtcctccgacggtcgtaggaggaccggaggtcgtagtattacgttactacggcacgtacttacaaattaaactaaaacctaaaacgtaaacggtaaaaccttacgggtttacggggtttacggggttacccggggacggggtaacccgggtaaacccggtaaaaaccgttccggtaaacccccgttaccggttaaaccccggttaccggaacccggaccccgtaaaccgggtccccgtacccggtaccccccggtttcggtaaccccttacccgttcccgtttacccggtttccccccccg

SEQ ID NO: 365894 - DNA, 583 bp, Homo sapiens
  misc_feature: GZ8MTXP02ICIQ1.51.53.E09.1.454.CMB.2.raw
  modified_base (253)..(253): a, c, t, g, unknown or other
  modified_base (429)..(429): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaccacatgactattgtacttatattctntctctgtacaacactacccgcaacgtcccaactcatgatcttgagtcagtgatcggcccgcgtaggggtttctcgatcgcttcctccccggctaccacgtctggcacgccgaccgggccctcccgtacgaccctagtcctcgtcggggtcctacccgaggctaggaggacggacgnttagtacttacttacgtgacagtctacaattacaaacaaacaagtaaactacggtgggttcggtacgggcggacggtaacctaacggtcgacccgttcacgtcgaccgaccgacgccgtcccgacccgtcgactccgtcgtccggtttcccccg

SEQ ID NO: 365895 - DNA, 813 bp, Homo sapiens
  misc_feature: GZ8MTXP02JX2T9.51.53.E09.1.454.CMB.2.raw
  modified_base (415)..(415): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtcctctggacagtcgatcaccatcctctgcactaggaaccacaatgactattgtacttatattctgtctctgtaccaacaactacccggacaactacccaaatcatgtatcttgagtcagtgacgtccggcccgtaggtacgggtttctcagttccgtcctttccgtccccggtacctaccgtaaacgtcgtacggcacggccgacccgggtcccttaccccggtnaaccctacgttccgttcggtccgggtcccttaccggacgggtaccggtagggaaccgggggacggtacggtaccgttagttaacttttaaccgttacgtacgtacgtacggtacttaacgttaaattaaaccgtaaaaccaaaaacgttaaaccggtaaaaccgtttacgggggtttacgggggttaccggggtttaccggggaaccccgggggtaaaaccggggtaaaaccccgtaaaacccggttaccggtaaacccccggttaacccggttaaccggttaacccggaacccggtaaaccccggtaaccgggtaacccgttacccccggttacccccggttaccgtttaaaccccgtccccggtttaacccccggtttccccccttaaccccccgg

SEQ ID NO: 365896 - DNA, 675 bp, Homo sapiens
  misc_feature: GZ8MTXP02F36LF.51.53.E09.1.454.CMB.2.raw
  modified_base (505)..(505): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactacggaaccaaccaatcgactagttggtacttaatattctgtctctgtaaccaacacgtacccgacaaacgtacccaaactcatgattcttaggacgtcagtagacgtccggcccgtggtacggggtttcctctacgtccgtccttccgtcccggtcctaccgtaagtcgtacggaccacggtaccgcccggtcccctcccgtacgaccctatccgtcgtcggtccctacgagcgtaggacggtacgacggtctagttacttacgttacgcggactagtacctanaaattaaaccaaaaccaaaacgtaaaccggtaaacgttcgggtttacggggttacggtaccggggacgggtaccggaaacctaaacggtcgaacccgtactaccggaccgacgacccggtaacggcctcccggtacccgtcggaccttaccgtccgttaccctacccccg

SEQ ID NO: 365897 - DNA, 714 bp, Homo sapiens
  misc_feature: GZ8MTXP02HOJSF.51.53.E09.1.454.CMB.2.raw
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtacggaacccaaccaatgaactagttgtaacttataattctgtctcctggtaccaaacaactaccccggacaaacgtaccccaaactcatgtattcttgagtcgagtagacgtccggcccgtcggtaaggggtttctctacgtcgtcttaccgtcccccggtcctaccgtaacgtccgtacgggaccgacgcccgtacccgggtccccctaccccgtaccgtacccctaacgttccttcccgggtcgggtacccgtacccggtacggtacggtacgggtaacgggacggtacggtcgttaacgtagtttacgttacgtcgtacgactacttacaattaaccaaactaaaacgaaacgtaaacgttacgggtacgggttgggtaccggggtccggaaaccgggtaacctaaaaccgtcgtaaaccggtccgtaccgtaccgaccgcccgaacgccgtccgtcccgtacggtccaccttccgtccgttcccccg

SEQ ID NO: 365898 - DNA, 829 bp, Homo sapiens
  misc_feature: GZ8MTXP02GGEFU.51.53.E09.1.454.CMB.2.raw
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctctgcactcggaaccacaatgacattaggtacttataattctgtctctgtaccaacaactacccggacaaaccgtaccccaaatcatgattcttgagtcagtgacgtccggcccgcgtacggggtttctcgactcgtcttctccccggcctaccgaagtcgtggcacgtccaccggcctcccgtacgacctactccgttccgtacggggccttacccggaacggtccgttagggaaacggggaacccggtaagggtccgttaaagggtttaacgtttaacttttaaacgtccggggaacctaacggtaccctttaaccaaagtttaaaaccgtaaaacctaaaaaaccgaaaaccggtaaaaaaccggttccggggtttttaacgggggtacccggggtttaccgggggaacccgggggaaccccgggggttaaaaccccaaaaccgggttaacccggttaaaaccccggttaaccccggtttaaacccggtacccggtaaaaacccggcccccggtttaaaacggaacccccggttacccccggtcccccccgtttacccgggggttaccccttaacccggttcccccggtttaaccccgttttacccccccccg

SEQ ID NO: 365899 - DNA, 631 bp, Homo sapiens
  misc_feature: GZ8MTXP02HYZ2I.51.53.E09.1.454.CMB.2.raw
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgactattggtacttataattctgtctctgtaccaacaataccccggcaaagtccccaaactcatgatctttgaggtcagtgactcggccccgcgtaggggttttctcatccgcttcctcccccggctccaagtcctggcacgcaccgggtccctccctgacccatctctcgggcctccgaggctggaggacgaggctgtacttacttactgacagctactattaacaacaaaactaacgaaaactcgtttacgggggtagtttccggggacgggacccgggggtaaacctaaaacggtccggtaaaccgttaccccgtaacgtaccgaccgaccccgaaacggccccgtccggtacccccgttcggtaccctaccgttacgttacccggtttcccccccg

SEQ ID NO: 365900 - DNA, 578 bp, Homo sapiens
  misc_feature: GZ8MTXP02HXASZ.51.53.E09.1.454.CMB.2.raw
  modified_base (421)..(421): a, c, t, g, unknown or other
  modified_base (438)..(438): a, c, t, g, unknown or other
  modified_base (447)..(447): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccacaatgactattggtacttataattctgtctctggtaccaacaactaccccggacaaacgtccccaaactcatgatcttgagtcagtgatccggccgcgtaggggtttctcagtccgtcttccgccccgtcctccaacgtctggcagccgacggccctccctcgaccagtctcgcggacctccgagctaggagacgnggtctagtattagtacngtcagctanatacaaacaaacgagtaaacgtgttcgggtagttccgggacggaccgggaactaacggtcgaccctaccgtacgtaccgacgaccctaaggccttacccgcccgttacgactaccgtctttaccgtccccc

SEQ ID NO: 365901 - DNA, 556 bp, Homo sapiens
  misc_feature: GZ8MTXP02H0J8F.51.53.E09.1.454.CMB.2.raw
  modified_base (320)..(320): a, c, t, g, unknown or other
  modified_base (398)..(398): a, c, t, g, unknown or other
  modified_base (407)..(407): a, c, t, g, unknown or other
  modified_base (411)..(411): a, c, t, g, unknown or other
  modified_base (427)..(427): a, c, t, g, unknown or other
tcagcgatcgtatacacgaccggtgctcgatttagagagagtgtgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgactattggtacttataattctgtctcctggtaccaacaatacccggcaaagtcccaaactcatgatctttgagtcagtgatcggcccgnaggggtttctcatcgcttctcccggctccaagtctggcagcacggcctccctgaccactctcgtgggctcccgagtcncgaggacgnggcncgatttagtactgacngctcatataacaaacaagaaactacgtaggtacggttcggcggacgggaccgaacgtacgaccgtacctacgtaccgacgacccgaacgccgtccgccccgtaccggtccgacctccgtcgtttccccc

SEQ ID NO: 365902 - DNA, 617 bp, Homo sapiens
  misc_feature: GZ8MTXP02I6OE9.51.53.E09.1.454.CMB.2.raw
  modified_base (282)..(282): a, c, t, g, unknown or other
  modified_base (330)..(330): a, c, t, g, unknown or other
  modified_base (354)..(354): a, c, t, g, unknown or other
tcagcgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactaggaacccacaatgactattggtacttatattctgtctctaggtaccaacaacgtacccgganaaacgtaccccaaactcatgattcgttgacggtcagtgactccggccncggtaggttctcatccgtcttccnccccggtctaccgtagtcgtggccacgccgaccgtcccgtccctacgaacctcttccgtcggtcgggcccttacccggaggtcccgtagggaacggacgacggtctaacgttagtttacttacgtcgactacggactacctaattaactaaacaaacgtaagaacgttacgtgggtacgtcgggcggtacggaactacgtccgaccgttctaacgtcacgtaccgacgccgtccgtccctcggctaccgtctccggttccccc

SEQ ID NO: 365903 - DNA, 685 bp, Homo sapiens
  misc_feature: GZ8MTXP02HULT7.51.53.E09.1.454.CMB.2.raw
  modified_base (301)..(301): a, c, t, g, unknown or other
  modified_base (303)..(303): a, c, t, g, unknown or other
  modified_base (307)..(307): a, c, t, g, unknown or other
  modified_base (310)..(310): a, c, t, g, unknown or other
  modified_base (316)..(316): a, c, t, g, unknown or other
  modified_base (324)..(324): a, c, t, g, unknown or other
  modified_base (333)..(333): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtcgtgggtctccgtggacagtcgactcaccatctctgacactcggaaccaaccaatgactagttggtacttataattctgtctctacgtacaacaactaccgcaaacgcccaatcatgntnttgngtnagtgcnccggccgngtcggttcnactcgtctcgtcccgtctacgtagtcgtgacacgccgaccggtcctaccctcgaacctctctccggtaccgggtcctacggacggtcgacgggaacggtcggacggtacttggtaaatttgttaacgcgtactacggtcttaaacgaaattaaccgtaaactaaaaacgaacgttaaaacgttcggggttacggggttacgggttaccggggaacggggaacccgggtaaacctaaaacgggttcccgtaaaccggtccgttaaaccggtaccgaaccgggaaccccgacggtcccgtccccggtacccccggtacgtccgtacccttcggggtttcccctttccccccggg

SEQ ID NO: 365904 - DNA, 702 bp, Homo sapiens
  misc_feature: GZ8MTXP02HL2VT.51.53.E09.1.454.CMB.2.raw
  modified_base (273)..(273): a, c, t, g, unknown or other
tcagcgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactcgaaccacaatgactattgtacttatatctgtctctgtaccaacactacccganaacgtacccaatcatgatcgttgacgtcagtacgacgtccggcccgtgttacggggtttctcagttccgtcctttaccgtcccccgggacctaccgtaagttccgtcggaccgtaacgcccgtaacccgggtccctaccccgtacgtaaccctacgtccgtcgtcgggtacctaccgagggtccgtaggaacgggacgtaaggtcttaggtaaactttacgtacgtacgaccgtagacctttacaaacttaaactaaaaccaaaacgtaacgtaaaaccgttcgggtttacgggggtacggttacccggggacgggtaacccggtaaaacctaaaacggtccggtaacccgttaccggtactaccgaccgtaacccgagcccgtcccggtaccccgtacgtacctaccgttccgttaccccgtaccccc

SEQ ID NO: 365905 - DNA, 587 bp, Homo sapiens
  misc_feature: GZ8MTXP02G8LUS.51.53.E09.1.454.CMB.2.raw
  modified_base (376)..(376): a, c, t, g, unknown or other
  modified_base (394)..(394): a, c, t, g, unknown or other
  modified_base (438)..(438): a, c, t, g, unknown or other
tcagcgatcgtatacacgaccggtgctcgatttagagagagtgtgttggggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcactgaaccacaatgacattgtactatattctgtctctgtacaacaactacccggcaaactacccaactacatgtattcttagaggtcagtgactcggcccgcgtacggggttctcatcgtcttcgccccggctaccaagtctcgacacgcacggcctcccngaccactctcgtcggccnccgagcgtgaggtacgagcgtagtattactattcgactagctanaactactaaacaaaacaaacgtaaactacgttacgggttggttaccgggacggtaccgggtaaacaacgtcggtacccgtccgtaacgtccgaccgacccgaacgaaccgtccgcccgtacgtaccacctttccgaccgtttacccccg

SEQ ID NO: 365906 - DNA, 799 bp, Homo sapiens
  misc_feature: GZ8MTXP02FYMW8.51.53.E09.1.454.CMB.2.raw
  modified_base (216)..(217): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctccnncactgaaccacaatgactattgtacttatattctgtctcgtgtaccaacaactaccccggacaaacgtaccccaaactcactgtattcttgagtcagtgacgtccggcctcgtacgggttctcacgtcgtcttcgccccggtctcgagtctcggacacggccgacggtcccctaccgacgaccctacgtccgttccggtacggtccgttaacccgagggtacgtagggaacgggtaaacggtcgggtacttacgttaaacgtttaccgttacgtcggaaacctacggtaccttaacaaacgttaaaccgttaaaaacccgaaaaacgttaaacgggtaaaacccggtttacggggttacgggggtttaccgggttaaccgggggacccccgggggtaaaaccgggtaaaaccccgttaaaacggttacccggggtaaacccccggtttaaacccgtaacccggggttaacccgaaacccggtaccccccgggttaaaaggggtcccccctccccgggttacccccccggttaacccgggtaaccctttaacccggggttccgtttacccggggtttaacccc

SEQ ID NO: 365907 - DNA, 645 bp, Homo sapiens
  misc_feature: GZ8MTXP02FI3QW.51.53.E09.1.454.CMB.2.raw
  modified_base (325)..(325): a, c, t, g, unknown or other
  modified_base (347)..(347): a, c, t, g, unknown or other
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgactattgtacttatattctgtctctgtaccacaactacccggacaaacgtacccaaactcatgatcgttgagtcagtgacgtccggccgngtacgggttctcatcgtcttcnccccggtctaccatcgtcggcgacgcctaccggccctccgtacgaacctacttccgtcggtcgggtcctacccgagggtccgtagggaacgggacggtacgtcgttagttactttaacgttactcggactacgtctaacgtaattaacttaaacaaaaccgaaacgtaaaccgtaacggtttcggggtcggtacggggtcgggaacccgggtaaacctaaacggtcgtacccgtaccgtacgtaccgacgaccgtaaggcccgtaccgtcccgtcgtacctctccgtaccttaccccg

SEQ ID NO: 365908 - DNA, 761 bp, Homo sapiens
  misc_feature: GZ8MTXP02HFE2J.51.53.E09.1.454.CMB.2.raw
tcagcgatcgtatacacgaccggtgctcgatttagagagagtgtgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccacaatgacattgtacttatattctgtctctgtacacaactacccgcaacgtcccaaatcatgatcttgagtcagtgacgtccggcccgtacgtacggggtttactcctacgttccgtacctttccgtcccccgggtaccttacccgaaagttccgttacggacgaacgtccgaacccggggtccctaccccggttagaaccctactccttcgggtccggggtaccttaccccgaagggtcctagggaaccgggtacggacgggtacttacggtaatttacttaacgtcggactaacgtcttaaacctaactaaaggttaaaaccaaaaccgggttaaaacgtaaaccggttacgggtttacggggttacgggttacccggggaacgggtaacccgggtaaaacccgtaaaccggtcccggtaaacccgttacccgttaaccggtaccgaacccggtacccgtaaccgggccccgttacccggtacccccggttaccggtacccgtacccgttccccgttaccccgttccccgg

SEQ ID NO: 365909 - DNA, 556 bp, Homo sapiens
  misc_feature: GZ8MTXP01CH88K.2.55.E11.1.454.CMB.2.raw
  modified_base (282)..(282): a, c, t, g, unknown or other
  modified_base (365)..(365): a, c, t, g, unknown or other
  modified_base (501)..(501): a, c, t, g, unknown or other
  modified_base (517)..(517): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctatttaaaggtgtccagtgtgaggtgcagctggtggcgtcgtgggggaggcttcgtaaatccgtgggggtcccttggactctcctgtgcaggccctgaattcactctcaataangcctacataaactgggtccgccaggctccgaggggagggctgggagtgggttggccataattaaagcaaatctgatggtgganaatacactaacgctgcacccgtgaaaggcagatcaccatctacaagtagactacttacaaagtaattcattagtatctggactaaatcgaaactagtttacgaaaaccgtggacacagtccgtagtattaattganagctaggcttacgttnttcctccgtgggccagggtacccttggtccaaccgttcc

SEQ ID NO: 365910 - DNA, 614 bp, Homo sapiens
  misc_feature: GZ8MTXP01CLKDZ.2.55.E11.1.454.CMB.2.raw
  modified_base (283)..(283): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaggtgtccagtgtgaggtgcagctggtggcgtcgtgggggaggcttcgtaaatccgtgggggtcccttggactctcctgtgcaggccctgaattcactctcaataangcctacataaactgggtccgccaggctccgaggggaagggcgtggaggtgggttggccaataataaaagcaaatctgatggtagggacaatacactaacgctgcacccgtgaaaggcagatcaccatctacaagagacacttacaaagtaaatttcaattgtatactaggactaaatgaaactaggtttaacgaaaacccgaggaacacaaggtccgttagtaatttaatggttaaacagccgttagggaacttaacgttctttacccgtccccggtgggggaacccctaacgggggtaaccccttggggtaacccttaaccccggtttcc

SEQ ID NO: 365911 - DNA, 588 bp, Homo sapiens
  misc_feature: GZ8MTXP01ALHAJ.2.55.E11.1.454.CMB.2.raw
  modified_base (286)..(286): a, c, t, g, unknown or other
  modified_base (307)..(307): a, c, t, g, unknown or other
  modified_base (356)..(356): a, c, t, g, unknown or other
  modified_base (440)..(440): a, c, t, g, unknown or other
  modified_base (483)..(483): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctatttaaaaggtgtccagtgtgaggtgcagctggtggcgtcgtgggggaggcttacgtaaagtccgtggggggtcccttggactctcctgtgcaggcctgaattcactctacaataangcctacataaactcgggtccnccgaggctccgaggggaggctggagtgggtgcataattaaagcaaatcngagtcggtaggacaatacactaacgctgcacccgtagaaagcagacttacacatcacaagagactatacaagtaaattctattntatcaggacaaatagaactaagttacgaaaacgtagaacaacngtaccgtagttataagttgacacgcgtaggacttacgttacgtttcctcccgggttaggggcccgaacggggtacccgttcgggtaacccttaaccggttccccg

SEQ ID NO: 365912 - DNA, 714 bp, Homo sapiens
  misc_feature: GZ8MTXP01COQ9V.2.55.E11.1.454.CMB.2.raw
  modified_base (256)..(256): a, c, t, g, unknown or other
  modified_base (279)..(279): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggagcttcgtaatccgtgggggtccttggactctctgtgcnggcctgattcactctacaataancgacctacaataaacgtcgggtccgccgaggcctaccggaggggagggtcgtgggtaggttggggtcggacctaattaaacgtaaaagacaaagtctagagtgggtaggacagtacacgtaacgctcgaccgaccgtagaagcacgtactaccactactacacgaagacgtacgaacttacaaagtaacttacagttcgtatctagactaaagtacgtaaacgtagttaacggaaaacccgaggaaccctaacggtacggtaccgtttagtttaaacgttaacggttacgttaacgtacggttaccggttaacggtaacccttaaccgtttccggtttacccccggttaaccccggggtaaccggggggtaaccccgtaaacccgggggttaccccgttaccgggggtaaccccttaaccccggggtttcccccg

SEQ ID NO: 365913 - DNA, 626 bp, Homo sapiens
  misc_feature: GZ8MTXP01BLXDJ.2.55.E11.1.454.CMB.2.raw
  modified_base (314)..(314): a, c, t, g, unknown or other
  modified_base (320)..(320): a, c, t, g, unknown or other
  modified_base (389)..(389): a, c, t, g, unknown or other
  modified_base (485)..(485): a, c, t, g, unknown or other
  modified_base (548)..(548): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggagtcttcgtaagtccgtgggggtcccttggactctcctgtcgcacggtcctgaacttcactctacaataactgacctaacactaaacgtgggtaccncgagcnccgaggggaacgggctgggaggtgggtcgacctagtaattaaagactaaatcgagagtcgggtaggaanatacactaacgctggacacccggtagaaacgtcgaacgtacttccaaccgtatacgtacaaaggactaactaacttacgaaaataactactaattntatctagactaaatacgaactaagttaacgaaacgtagacatacggtctaggtattaacgttnacagttcgtagtacttacgttaccttcgtcccgggtgggaaccgtacgggtaccttcgggtaaccttaacccggtccc

SEQ ID NO: 365914 - DNA, 560 bp, Homo sapiens
  misc_feature: GZ8MTXP02INKI1.2.55.E11.1.454.CMB.2.raw
  modified_base (289)..(289): a, c, t, g, unknown or other
  modified_base (354)..(354): a, c, t, g, unknown or other
  modified_base (398)..(399): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggaggcttcgtaaatccgtgggggtcccttggactctcctgtgcaggccctgattcactctcaataatgcctanataaactggtccgccaggctccgaggggaagggctggagtgggttgccagtattaaagcaaatcngatggtggacaatacactacgctgcaccgtgaaagcagatcacnnctacaagagacattacaaagtaaattcattgtaatctagactaaatgaaactagtttagaaaaccgaggtacaacgagtaccgtagtactttagtcgtacaggtactcggacacgttactctaacccggtgggacctacggggaacctgggtaccaccgtc

SEQ ID NO: 365915 - DNA, 624 bp, Homo sapiens
  misc_feature: GZ8MTXP02II1E0.2.55.E11.1.454.CMB.2.raw
  modified_base (355)..(355): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggaggcttcgtaaatccgtgggggtcccttggactctcctgtgcaggccctgaattcactctcaataatgcctacataaactggtccgccaggctccaggggaagggctggagtgggttggccatattaaaagcaaatcngatggtggacaatacactacgctgcacccgtgaaacggcagattcacctatctacaagagactacttacaaagaaattcattgtatctagacaaatgaaactagtttaagaaaaacccggtaggaaaccacgtaacgccgttagttaactttagttacgttacacgtaccttacgggtaacctaacgttaacgtttcccgtaacccggttcgggggaccccgtaccgggggaaaacccctttcgggggtaccctaaccccggtttcccg

SEQ ID NO: 365916 - DNA, 584 bp, Homo sapiens
  misc_feature: GZ8MTXP02I2BDU.2.55.E11.1.454.CMB.2.raw
  modified_base (410)..(410): a, c, t, g, unknown or other
  modified_base (474)..(474): a, c, t, g, unknown or other
  modified_base (498)..(498): a, c, t, g, unknown or other
tcagacgctcgacacacgaccggtgctcgatttagcactcgcacgttgggtttgggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggaggcttcgtaaatccgtgggggtccttggactctctgtgcagcctgattcactctcaataatgcctacataaactcgggtccgccaggctccgaggggaagggcgtggagtgggtggccatataaagcaaatctagagtggtaggacaatacactacgctcgacaccgtagaaagcagatcacatcacaagnacactcaaagtaatcatgtatctagacaaatcgaaactaggttaacgaaaaccgtgaacaacgngtacgtagttaattacgttgaacncgtacgtacggactaaccttgtttccgaacccggtacgggggacctaaccgggggtaacccttcgggtacccgtacccggtttccc

SEQ ID NO: 365917 - DNA, 683 bp, Homo sapiens
  misc_feature: GZ8MTXP02JVOHR.2.55.E11.1.454.CMB.2.raw
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggaggcttcgtaaatccgtgggggtcccttggactctcctgtgcaggccctgaattcactctcaataatgcctacataaacgtggtccgccaggctaccgaggggaaggggctggaggtgggttggcatataaaagcaaatctagatcggtagggactaatacactacgctcgccaccgtgaaagcagactcacatctacaagacacacttacaaaagtaaacttcgtaatttacgtacttacgtaggtaaccaaaagttagtaaaaccgtaaagggttttaaacgaaaaaaccccgggtagggaaacccgtaacgtaacggggtacccgttaggttaaaacttttagttaacggtaaaccgaggtaccgttacgggaaacccttacgttaacgtttcccggtaaccccggtacgggggtacccctacgggggtaaaccccctcgggtacccgtaccccggtttcccg

SEQ ID NO: 365918 - DNA, 593 bp, Homo sapiens
  misc_feature: GZ8MTXP02GB1B4.2.55.E11.1.454.CMB.2.raw
  modified_base (383)..(383): a, c, t, g, unknown or other
  modified_base (398)..(398): a, c, t, g, unknown or other
tcagacgctcgacacacgaccggtgctcgatttagcactcgcacgttgggtttggggctgggagaggagccccagccttgggattcccaagtgttttcattccgtgatcaggactgaacacagaagactcaccatggagtttgggctgagctggattttccttgctgctattttaaaaggtgtccagtgtgaggtgcagctggtggcgtcgtgggggaggcttcgtaaatccgtgggggtcccttggactctcctgtgcaggccctgaattcactctcaataatgcctacataaactgggtccgccaggctaccaggggaagggctggagtgggttggccatattaaaagcaaaatctagatggtagggacaatacactacgntgcaccgtgaaacgnagatcacatctacaaagagacacttacaaagtaaattcaattgtaattctagactaaatagtaaactagtttaacgaaaaccgaggaacctacgagtaccgtaggttaattaattgtaacagtaccgtaggaactaactacgttacgtcccgtacgggggacctacggggaacccttcggccaacccggtttccc

SEQ ID NO: 365919 - DNA, 929 bp, Homo sapiens
  misc_feature: GZ8MTXP02INU75.2.55.E11.1.454.CMB.2.raw
  modified_base (252)..(252): a, c, t, g, unknown or other
tcagacgctcgacacacgaccggtgctcgatttagcactcgcacgttgggtttggggctgggagaggagccccagccttgggattcccaagtgtttcattccgtgatcaggactgaacacagaagactcaccatggagtttgggctgagctggatttcctgctgctatttaaaggtgtccagtgtgaggtgcagctggtggcgtcgtgggggagcttcgtaaatccgtgggggtccttggactctcctgtgnacggccctgaacttcactctacaataactcgtacctaacaacgttaaaccgtcggggtacccgacccgtaacgggcccgttacccggaaggggggtaaacggggccgttagggggtaacgggttcgggggtttacggggaaccccgttaaaggtttaaacggtttaaaaacggtaccgtaaaaacgttccggtaagggtaacgttaccgggggtaacggggtaaacctaaaacggttaacgaaccgttaacccggtacgtccggtaacccgtaaacccccggggttaaaggtaaaaccggggaccgtaaacgggtaaccttttaaccccgaaacccgttaaacgttaccctaaacgtaaaacggaaacggttaaaccccttaaaaccgttttaacgaaaaacggttaaaacgtttacctaaacgtttaggttaaaaccttcccgttaaaggtaaaccttaaaagttacggttaaaaacgtaacggttttaaaaccggaaaaaaccccgggttagggtaaaccaaccgggttaaaccgttaaccgggttattaaaaccgtttacgttacgggtaaacctggtacgttaacggtaccctaacgttaaccggttcccgtaacccgggttaggggaccccgtaacgggggtaaccccttcggtacccgttaacccgtcccg

SEQ ID NO: 365920 - DNA, 610 bp, Homo sapiens
  misc_feature: GZ8MTXP01C6MHQ.41.70.G04.1.454.CMB.2.raw
  modified_base (212)..(212): a, c, t, g, unknown or other
  modified_base (449)..(449): a, c, t, g, unknown or other
tcagtctatactatcacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttcncactcgtcactcctggagagggcgttgtcgtgggtgcggcacgcccccggaaggcctggagtggatcgcactcacttatggaatgacgatatacgatatagtccttctctgacgaccagactcacgcctacaacggaaggacaaccgtaaacccaaaaaccgtggtacggtacccttaacacgttacgaaccaacggtcggacccttggtacggacacgaggaccactattatttcngtcgaccctacttcagtcgaacccaacaacgtcgaacccgacgggtcctttaccgttaccggaacccggtggggacccgaagggtaactccgacgggttccaccgtctcacgttcacgccctaccgaaccgacgggcccttagttcccggttccttccccg

SEQ ID NO: 365921 - DNA, 558 bp, Homo sapiens
  misc_feature: GZ8MTXP01C0OGY.41.70.G04.1.454.CMB.2.raw
  modified_base (212)..(212): a, c, t, g, unknown or other
  modified_base (366)..(366): a, c, t, g, unknown or other
  modified_base (424)..(424): a, c, t, g, unknown or other
  modified_base (528)..(528): a, c, t, g, unknown or other
tcagtctatactatcacgaccggtgctcgatttagtgtagtgtgaagggaaagggggactcctgtgccccaccatggacacactttgctccacgctcctgctgctgaccatcccttcatggggcctgtcccagatcaccgtgaaagagtctggccctacattggtgaaacccacacagaccctcacgctgacctgcaccgtctcaggcttcncactcgtcactcctggagagggcgttgtcgtgggtgcggcacgcccccggaaggccctggagtgatcgcactcacttatggaatgacgatatacgatatagtccttctctgacgacagactcacgcctcacgaagaccacgtaacccaaaacgnggtcgtaccttacattcgaaccaacgtcgaccctgcggacacaggcagtattatttcngtcgaccctactttaccattacgaacctaacaactcgaacccgacgggtccttccgtaccgaacccgtgggaccagggaactcgaggtcacgtctcagttcacnccctcaacgacggccatccgttcctccccg

SEQ ID NO: 365922 - DNA, 557 bp, Homo sapiens
  misc_feature: GZ8MTXP01DCLKP.10.38.D05.1.454.CMB.2.raw
  modified_base (341)..(341): a, c, t, g, unknown or other
  modified_base (409)..(409): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtggttttcgtgttaggctatttacaaaaggtgtccatgtgaggttcaactggtggagactgggaggaggctggatccagcctgggggggtcccctgagactctcctgtgcagcctctgggttcagcatcagtaacactacatgacctgggccccgccaggctccgagggggaagggggctgggagtggggtcnagttatgaaacagactggcactacataattattctgtactccgtgaacgggcgggtcaccctctccanagacacttaccaacaacaatcttatatactactacacgtacacactactactagagagtacgacgacgaccgacctactaacttattgtcgcgcgacacgttcgttactaacgtactaactacgtcggttcgggtcggaacgggaacg

SEQ ID NO: 365923 - DNA, 547 bp, Homo sapiens
  misc_feature: GZ8MTXP01AOV5L.10.38.D05.1.454.CMB.2.raw
  modified_base (354)..(354): a, c, t, g, unknown or other
  modified_base (372)..(372): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccaccctattattgtgcgcgacntgactacgctcaattcgnggggccagggacgcccaggtccaccgtcctccccagccctccaccgaacgggcccagtccggggtccttcccccgtcggccgccctcgcctccgacggcgccacctccgagaacgcacgacgccggccctgggcttcgccgtggtcaacggctaccgttcccaacttaactaacg

SEQ ID NO: 365924 - DNA, 546 bp, Homo sapiens
  misc_feature: GZ8MTXP01EQA8A.10.38.D05.1.454.CMB.2.raw
  modified_base (355)..(355): a, c, t, g, unknown or other
  modified_base (358)..(358): a, c, t, g, unknown or other
  modified_base (409)..(409): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtggttttccgtgtagctatttcaaaaggtgtccatgtgaggttcaactggtggagactggaggaggctggatccagcctgggggggtccctgagactctcctgtgcagcctctgggttcagcatcagtaacgactacatgacctgggccccgccagggctccgagggggaagggggctgggagtgggggtctcagttattgaaaacngangacactactataattactctgacgtcgtaggacgggtccgttacaccctcncagacgacactacaacaactactctatactctactacacgtcacacaactactgagacgtacgacgaccgaccgaccactaattattgtcgcgcgacagttcgactaactctctacgtcgttcgggtcggaacggcg

SEQ ID NO: 365925 - DNA, 540 bp, Homo sapiens
  misc_feature: GZ8MTXP01DYOET.10.38.D05.1.454.CMB.2.raw
  modified_base (301)..(301): a, c, t, g, unknown or other
  modified_base (347)..(347): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccncaggctccgagggaaggggctgggagtgggtctcagttatgaaacngatggcactacataattatctgactccgtgaagggccggttcaccctctccagagacaccttaccaaacaactatcttagatcttcaacatgcaacaatcctgagagtacgacgacaccggcccaaccttaattattgtgcgcgaacagttcgacttaacgctaaccaattcgcggggcccaagggggaaccc

SEQ ID NO: 365926 - DNA, 554 bp, Homo sapiens
  misc_feature: GZ8MTXP01BDT12.10.38.D05.1.454.CMB.2.raw
  modified_base (522)..(522): a, c, t, g, unknown or other
tcagcatagtagtgcacgaccggtgctcgatttagtatctgatagttgggtttccttgttgctatttcaaaaggtgtccactgtgaggttcaactggtggagactggaggaggctggatccagcctgggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacaacggccaactattattgtgcgcgacatgactacgctcaattcgtggggccaggggacgcccaggtccaccgtcctccccgacgccctccgacccaaacgggccccagtccggtccttcccccgtgggcccgcccctggttcccagggacgccacccgtcccgagacgcacgngccggcccgtgggcttcgcccgttggtaaccg

SEQ ID NO: 365927 - DNA, 602 bp, Homo sapiens
  misc_feature: GZ8MTXP01DQDTV.10.38.D05.1.454.CMB.2.raw
  modified_base (275)..(275): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcancagtaacgactacatcgacccgtgggccccgccgagggcctccgaagggggaagggggcgtgggaggtcggggtctcgtagttattagaaacagactggcactacataattattctgactcgtgaacgggtccgttcaccctctccagacgacctacttaccaaacactattcttgtaacttcttacaacattcgacaactaaatcctagagacgtaccgacgacaccggcccaaccgttaattagttggtgccgtacgacttagttcgaacctaacggcttaacgaaacgttcgggttacgggggccccgttaagggggaaccccg

SEQ ID NO: 365928 - DNA, 523 bp, Homo sapiens
  misc_feature: GZ8MTXP01CAGWK.10.38.D05.1.454.CMB.2.raw
  modified_base (358)..(358): a, c, t, g, unknown or other
  modified_base (504)..(504): a, c, t, g, unknown or other
  modified_base (516)..(516): a, c, t, g, unknown or other
tcagcatagtagtgcacgaccggtgctcgatttagtatctgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccacccaggcaaacgcccccaaactccttgttttgagtcagtaagcggccctcaggatccctgatcggttctctcgcctcaagtctggcaacncggcctccctgaccgtctctgggctccaggctgaggatgagctgattacactgcagcggcatattcgaggccccaacgagggtgtttgggcggtcgggactaagggtcgaccgttcgtgggttcagccaaggcttcgcccctggcnctcttcgtcccnccctccc

SEQ ID NO: 365929 - DNA, 535 bp, Homo sapiens
  misc_feature: GZ8MTXP01BEMR7.10.38.D05.1.454.CMB.2.raw
  modified_base (407)..(407): a, c, t, g, unknown or other
  modified_base (488)..(488): a, c, t, g, unknown or other
  modified_base (520)..(520): a, c, t, g, unknown or other
tcagcatagtagtgcacgaccggtgctcgatttagtatctgatagttggggtttggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcagcctcgtgggttcagcatcagtaacgactacatgaccgtgggccccgccaggcctccgagggggaagggggctgggagtgggtctcgagttatagaaacagatggcactacataattattctgactccgtgaacgggccgttcaccctcncagacgacacttccaaacacatctgtatcttacacatcgacacaatctgagagtcgacgaccacgcccaactaattattgngcgcgtacagttcgactaacgctaacattcgnggggcccaaggggcc

SEQ ID NO: 365930 - DNA, 534 bp, Homo sapiens
  misc_feature: GZ8MTXP01DOW0A.10.38.D05.1.454.CMB.2.raw
  modified_base (220)..(220): a, c, t, g, unknown or other
  modified_base (318)..(318): a, c, t, g, unknown or other
  modified_base (354)..(354): a, c, t, g, unknown or other
  modified_base (372)..(372): a, c, t, g, unknown or other
  modified_base (385)..(385): a, c, t, g, unknown or other
  modified_base (446)..(446): a, c, t, g, unknown or other
  modified_base (462)..(462): a, c, t, g, unknown or other
  modified_base (474)..(474): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttattgaaacngatggcactacatattatctgactccgtgaagggccgttcaccctctccagagacacttccaaacaacatcttgtatcttcacatgcacaatctgagngtcgacgacacggccaccctattattgtgcgcgacntgactacgctcaattcgnggggccagggacncccaggtcaccgtctccccagcctccaccaagggcccatccggggtccttccccgtggccnccctgcctccaggacnccacctcgagcncacgcggccggcccgtgggcttcgccgtggacaacggtcctaccttcctaacttaacgtg

SEQ ID NO: 365931 - DNA, 546 bp, Homo sapiens
  misc_feature: GZ8MTXP01DMGF5.10.38.D05.1.454.CMB.2.raw
  modified_base (376)..(376): a, c, t, g, unknown or other
  modified_base (424)..(424): a, c, t, g, unknown or other
  modified_base (435)..(435): a, c, t, g, unknown or other
  modified_base (454)..(454): a, c, t, g, unknown or other
  modified_base (469)..(469): a, c, t, g, unknown or other
  modified_base (493)..(493): a, c, t, g, unknown or other
  modified_base (501)..(501): a, c, t, g, unknown or other
  modified_base (528)..(528): a, c, t, g, unknown or other
  modified_base (536)..(536): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtggttttcctgtagctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaagggggctgggagtgggtctcgagtttattagaaacagatggacactacataattattcngacctcgtgaacgggccgttcaccctctccaggacacacttaccaaanactagtccttntaactcttacacaggttcncaacaattccagagngtaccgacgacacggccctaactnttattgtncgacacattcgacttcgctcaattcgnggggcccnggggtaaccg

SEQ ID NO: 365932 - DNA, 534 bp, Homo sapiens
  misc_feature: GZ8MTXP01BZ3QW.10.38.D05.1.454.CMB.2.raw
  modified_base (350)..(350): a, c, t, g, unknown or other
  modified_base (373)..(373): a, c, t, g, unknown or other
  modified_base (399)..(399): a, c, t, g, unknown or other
  modified_base (432)..(432): a, c, t, g, unknown or other
  modified_base (439)..(439): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctggggttttccttgttgctatttcaaaaaggtgtccactgtgaggttcaactggtggagactggaggaggctggatccagcctggggggtccctgagactctcctgtgcagcctctgggttcagcatcagtaacgactacatgaccctgggccccgccaggctccgaggggaagggggctggagtgggtctcagttatgaaacngactggcactacataaattatcngactccgtgaagggccgttcaccctnccagagacacttcaaacaacatcttgatcttanacaggtncacaatactgagagacgacgacacggccaccctaattaattgtgcgcgaccacttgactaacgctccaatacgttcgggtccgaacgggaaccgg

SEQ ID NO: 365933 - DNA, 539 bp, Homo sapiens
  misc_feature: GZ8MTXP01B2L6H.10.38.D05.1.454.CMB.2.raw
  modified_base (297)..(297): a, c, t, g, unknown or other
  modified_base (340)..(340): a, c, t, g, unknown or other
  modified_base (352)..(352): a, c, t, g, unknown or other
  modified_base (410)..(410): a, c, t, g, unknown or other
  modified_base (420)..(420): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagcgtgggtttcctgttgctatttcaaaggtgtccactgtgaggttcaactggtggagactggaggaggctggatccagcctggggggtccctgagactctcctgtgcagcctctgggtcagcatcagtaacgactacatcgacctgggccccncgaggctccgggggagggctggagtggtctcagttatgaaacngatcggcactanatattaattctgactccgtgacggtccggtcaccctctccagacgacacttcccaaanaaccatcttntatctctacatcgacactactactagagacgacgacgacgaccgacctacctattaatgttcgtcgcgactacttacgttcttacgtctacgtaacgtcgtcgggcggtaacggcgccg

SEQ ID NO: 365934 - DNA, 573 bp, Homo sapiens
  misc_feature: GZ8MTXP01BOCGO.10.38.D05.1.454.CMB.2.raw
  modified_base (519)..(519): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtgggccccgccaggctccgaggggaagggggctgggagtgggtctcagttatgaaacagatggacactacattaattattcagtactccgtagaacggggtccgttcacccctctcagacgacctacttaccaaacaactatcttagtactccttacacatcgacactaatctagagagtaccgacgaccaccggccaacttaattacttgtacgcgtaccganagttcgaacctaacgctaactaacttcggttacgggggcccaagggggaacccg

SEQ ID NO: 365935 - DNA, 544 bp, Homo sapiens
  misc_feature: GZ8MTXP01BO78G.10.38.D05.1.454.CMB.2.raw
  modified_base (219)..(219): a, c, t, g, unknown or other
  modified_base (261)..(261): a, c, t, g, unknown or other
  modified_base (349)..(349): a, c, t, g, unknown or other
  modified_base (382)..(382): a, c, t, g, unknown or other
  modified_base (466)..(466): a, c, t, g, unknown or other
  modified_base (476)..(476): a, c, t, g, unknown or other
  modified_base (481)..(481): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttatgaaacngatggcactacatattatctgactcgtgaaggccgtcacctnccagagacacttccaacaacatcttgtatcttcacatgcacaatctagagagtcgacgacacggccaaccctattatgtgcgacgacntcgactacgctacaattcgtggggccagggacncccgaggtccaccgtcctccccagccctaccaccgaacggcccactcggggtccttccccgtggccgccctgcctccgaggacnccacctccgngaacncacacgccggcctgggccttcgcccgtgggtccaacgggccttaccttcccgaacttcctaag

SEQ ID NO: 365936 - DNA, 535 bp, Homo sapiens
  misc_feature: GZ8MTXP01ENC4O.10.38.D05.1.454.CMB.2.raw
  modified_base (219)..(219): a, c, t, g, unknown or other
  modified_base (356)..(356): a, c, t, g, unknown or other
  modified_base (387)..(387): a, c, t, g, unknown or other
  modified_base (467)..(467): a, c, t, g, unknown or other
  modified_base (473)..(473): a, c, t, g, unknown or other
  modified_base (479)..(479): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttatgaaacngatggcactacatattattctgactccgtgaagggccgttcaccctctccagagacacttccaaacaacatcttgtatcttcacatgcaacaatctagagagtcgacgacacggccaacctattatgtgcgacgacntgactacgctacaattcgtggtacagggacncccaggtccaccgtcctccccagcctaccaccaacgggcccatccggggtccttccccgtgccgcctgcctcgaggaccnccaccncgagcncacgcgccggccgtcggcttcgccgtgacaacgtacctaccttacctaacttcgtg

SEQ ID NO: 365937 - DNA, 429 bp, Homo sapiens
  misc_feature: GZ8MTXP01AO8QE.10.38.D05.1.454.CMB.2.raw
  modified_base (238)..(238): a, c, t, g, unknown or other
  modified_base (250)..(250): a, c, t, g, unknown or other
  modified_base (304)..(304): a, c, t, g, unknown or other
  modified_base (401)..(401): a, c, t, g, unknown or other
  modified_base (419)..(429): a, c, t, g, unknown or other
tcagcatagtagtgcacgaccggtgctcgatttagtatctgatagttgttggaagtgtctctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcnggggccagggancccaggtcaccgtctccccagcctccaccaaggccccatccggtccttcccccnggccgcccctgcctccagggacgccacctccgagagcaccagcggccctgggctgccctggtcaaagggctacttcccactactatgctgagcgggntgggcaagggcgcatagnnnnnnnnnnn

SEQ ID NO: 365938 - DNA, 558 bp, Homo sapiens
  misc_feature: GZ8MTXP01B00KO.10.38.D05.1.454.CMB.2.raw
  modified_base (333)..(333): a, c, t, g, unknown or other
  modified_base (345)..(345): a, c, t, g, unknown or other
  modified_base (366)..(366): a, c, t, g, unknown or other
  modified_base (426)..(426): a, c, t, g, unknown or other
tcagcatagtagtgcacgaccggtgctcgatttagtatctgatagttgggtttgggggagaggagcccagcactggggattccgaggtgtttccattcggtgatcagcactgaacacagaggactcaccatggagttttggctgagcgtggttttcgtgttagctattcaaaaggtgtccatgtgaggttcaactggtggagactggaggaggctggatccagcctgggggggtccctgagactctcctgtgcagcctctgggttcagcatcagtaacgactacatgacctgggccccgcaggctccgaggggaggggctgggagtgggtctnagttatgaaacngactggcatacataattattntgactcgtcgaacgggccgggtcaccctctcacgacgacacttaccaacaaccaatcttntactctacacacgtctacactactactagagacgtacgacgtaccgaccgacctactaacttattgtcgcgacgacacgttcgttacgtaacgtacgtaacgtacgtacggttcgggtccggaacgggaacg

SEQ ID NO: 365939 - DNA, 543 bp, Homo sapiens
  misc_feature: GZ8MTXP01D3YCM.10.38.D05.1.454.CMB.2.raw
  modified_base (351)..(351): a, c, t, g, unknown or other
  modified_base (397)..(397): a, c, t, g, unknown or other
  modified_base (403)..(403): a, c, t, g, unknown or other
  modified_base (414)..(414): a, c, t, g, unknown or other
  modified_base (419)..(419): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctgggccccgcaggctccgagggggaaggggctgggagtgggtctcgagttatgaaacngatggcactacataattatctgactcgtgaacgggccgtcaccctnccaganacactcaacanatctnatctacacgatgacactaatcctgacgacgtacgaccgaacgaccggccctaaccgttaattagttcgtgcgacgaacagttcgaccttaagctaacaagttcgacggggcccaaggggaaccc

SEQ ID NO: 365940 - DNA, 567 bp, Homo sapiens
  misc_feature: GZ8MTXP01BQJ0J.10.38.D05.1.454.CMB.2.raw
  modified_base (261)..(261): a, c, t, g, unknown or other
  modified_base (268)..(268): a, c, t, g, unknown or other
  modified_base (341)..(341): a, c, t, g, unknown or other
  modified_base (366)..(366): a, c, t, g, unknown or other
  modified_base (452)..(452): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccgagggaagggctggagtgggtctcagttatgaaacagatggcactacatattatctgactcgtgaacgggccgttcaccctntccaganacacttccaaacaacatcttgtatcttcacatgcacaatctgagagtcgacgacacggccactattatgtgcncgaacatgactacgctacaattcgngggggcccagggacgcccaggtccacccgtcctccccagccctacccaccgaacgggcccagtcccggtccttcccccgtggcccnccctgcctccgaggacgcccaccgtccgagcgccaacgcggcccggcccgtgggggccttcggcccgttgggtaaccaaacggtcccttaccttccccacttaaccttaagtccg

SEQ ID NO: 365941 - DNA, 574 bp, Homo sapiens
  misc_feature: GZ8MTXP01EZ0D2.10.38.D05.1.454.CMB.2.raw
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctgtacagcaccaccagcaaacgccccaaacttccttttttgagtcagtaagcggccctcaggacgtccctgatcggttctctcgcccctccaagtctggcaaacacggccctccctgacccgtctcgtcgggctccgaggctggaggatgaggctgtattacactgcagcgcgtattacttcgacggccccaaagtcggggttgtttcgggcggtcgggtacgtaacgggtcgaaccgtcgttgggtcacggcccgaacgggcgttcggcccccgtcgggtccaaccgttccgtcgttccccgtcccttcccgtaaccc

SEQ ID NO: 365942 - DNA, 590 bp, Homo sapiens
  misc_feature: GZ8MTXP01DUGSO.10.38.D05.1.454.CMB.2.raw
  modified_base (405)..(405): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctcgtgggttcagcatcagtaacgactacatgacctgggccccgcaggctccgaggggaaggggctgggagtgggtctcagttatagaaacagatggacactacataattaattctgactcccggtagaacgggcccgttcaccctntccaggacacaccttccaaacaactatcttgactcttacaccaagtcacaaacaatcctgacgagtaccgacgaaccgaccggtccaaccttaatttaacttggtcgccgacgtaacagttcgaaccttaacggacccttaacgtaaacgtttccggacggggggtccccaagggggaaccccgg

SEQ ID NO: 365943 - DNA, 544 bp, Homo sapiens
  misc_feature: GZ8MTXP01CBVTF.10.38.D05.1.454.CMB.2.raw
  modified_base (243)..(243): a, c, t, g, unknown or other
  modified_base (270)..(270): a, c, t, g, unknown or other
  modified_base (287)..(287): a, c, t, g, unknown or other
  modified_base (498)..(498): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggcccgccaggctccagggaaggggctggagtgggtctcagttattgaaacngatggcactacatattatctgactcgngaaggccgttcaccctntccagagacacttccaacaacatcttgtatcttcacatgcacaatctgagagtcgacacaacggccaacctattactgtgcgcgacatgactacgctacaattcgtaggggccgagggacgcccgaggtccaaccgtcctccccgacgccctccacccgaacgggccccagtccggtccttccccctggcccgcccctgcctcgacggacnccgaaccctccgagcgccaacagccggcctcgggcctcgccgtcgg

SEQ ID NO: 365944 - DNA, 547 bp, Homo sapiens
  misc_feature: GZ8MTXP01A6R7I.10.38.D05.1.454.CMB.2.raw
  modified_base (400)..(400): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctggggttcagcatcagtaacgactacatgacctgggccccgccaggctccgaggggaagggggctgggagtgggtctcagttatgaaacagatggacactacattaattattctgactcgtgaagggccgttcaccctntccagagacacttcaaacactatcttgatcttacacagtcgctaacaatctgagagtaccgaacgtaccacggcccaacctaattagttgtcgcgacgacttagttgacctaacgctcaattcgttagggggcccaagggggtaacc

SEQ ID NO: 365945 - DNA, 562 bp, Homo sapiens
  misc_feature: GZ8MTXP01EKLB1.10.38.D05.1.454.CMB.2.raw
  modified_base (352)..(352): a, c, t, g, unknown or other
  modified_base (376)..(376): a, c, t, g, unknown or other
  modified_base (449)..(449): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctggggttcagcatcagtaacgactacatgacctgggccccgccaggctccgaggggaagggggctgggagtggggtctcagttattgaaacngactggcactacataattattctnactccgtgaacgggtccggttcaccctctccagagactacttcccaaacaactatcttgtatcttacacatanacaactaagtcagagacgtaccgacgacgaccgcctaacttaattagttgtcgcgacgaacagttcactaaccgctaacgtaacgttcgggacggggtaaccgaaggggtccg

SEQ ID NO: 365946 - DNA, 632 bp, Homo sapiens
  misc_feature: GZ8MTXP01D8OXB.10.38.D05.1.454.CMB.2.raw
  modified_base (430)..(430): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcgaccgtcgggccccgccgaggcctccggagggggaaacgggggcgtgggaggtcgggggtctcgtagtttattagaaacagatggacaactacataatttatctgacctccggtagaacggggtcccggttacaccctntcccagacgacctacttaccaaacactatctagtactcttacacgagtcacaactaaatcctaggagacggttaccgacgtaacccgaaccggtaccctaaaccttaatttaagttcggtcgaccgaccggaacttaagttcgaaacccttaacggcttaactaaacgttcggttacgggggaacccgaagggggaaccccg

SEQ ID NO: 365947 - DNA, 541 bp, Homo sapiens
  misc_feature: GZ8MTXP01EQEEB.10.38.D05.1.454.CMB.2.raw
  modified_base (350)..(350): a, c, t, g, unknown or other
  modified_base (404)..(404): a, c, t, g, unknown or other
  modified_base (478)..(478): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggcctccgaggggagggggctgggagtgggtctcagttatgaaacngatggcactacataattattctgactcgtgaacgggtccgtcaccctctcaganacacttaccaaacacatcttatatcttacacatgcacaatctgagagtcgacacaccggccacctaattattgngcgcgaacagttcgacttaacgcttaacgaactttcggacgggggtcccaagggggaaccccg

SEQ ID NO: 365948 - DNA, 538 bp, Homo sapiens
  misc_feature: GZ8MTXP01AJ2JS.10.38.D05.1.454.CMB.2.raw
  modified_base (352)..(352): a, c, t, g, unknown or other
  modified_base (358)..(358): a, c, t, g, unknown or other
  modified_base (364)..(364): a, c, t, g, unknown or other
  modified_base (374)..(374): a, c, t, g, unknown or other
  modified_base (401)..(401): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaaggtgtccactgtgaggttcaactggtggagactggaggaggctggatccagcctgggggggtccctgagactctcctgtgcagcctctggggttcagcatcagtaacgactacatgacctgggccccgccaggctccagggggaagggggctggagtggggtctcagttatgaaacngatggnactaanataattatcnactcgtgacggcgtcaccctctcaganactactaccaaacaacatctagtatctacacagtgacacaactactgagagtacgacgacgaccgaccacctaattaattgtgcgcgacagttcgactaacactaactaacttacgttcgggtccggaacgggaacg

SEQ ID NO: 365949 - DNA, 553 bp, Homo sapiens
  misc_feature: GZ8MTXP01E37NV.10.38.D05.1.454.CMB.2.raw
  modified_base (502)..(502): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctcgtgggttcagcatcagtaacgactacatgacctgggccccgccaggctccgaggggaaggggctgggagtgggtctcagttatgaaacagactggcactacataattatctgactcgtgaacgggtccgtacaccctctccagacgaccacttaccaaacaactatcttgtactcttacaacatgaccaacaatcctgaagacgtaccgacgaaccaccggacccaccttaattattggtcncgtacgaacagttcgactaacgctaacaattcgcggggccaaggggaaccg

SEQ ID NO: 365950 - DNA, 537 bp, Homo sapiens
  misc_feature: GZ8MTXP01C87E0.10.38.D05.1.454.CMB.2.raw
  modified_base (351)..(351): a, c, t, g, unknown or other
  modified_base (421)..(421): a, c, t, g, unknown or other
  modified_base (450)..(450): a, c, t, g, unknown or other
  modified_base (454)..(454): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgagggggaaggggctgggagtgggtctcagttatgaaacngatggacactacataattattctgactccgtgaacgggccgttcaccctctccagagacacttaccaaanaacatctgtatcttcacatgcaacaatcngagngtacgacgaccacggccaccttaattattgtcgcgcgacattcgacttaacgctccaagtttcgagggggcccaagggggccc

SEQ ID NO: 365951 - DNA, 537 bp, Homo sapiens
  misc_feature: GZ8MTXP01AP47P.10.38.D05.1.454.CMB.2.raw
  modified_base (404)..(404): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgagggggaagggggctgggagtggggtctcagttatgaaacagatggacactacataattattctgactccggtgaacgggccggttcaccctntccagacacacttccaaacaacatcttgtatcttacacatgcacaactactgagagtacgacgacacggccacctaactattgtgcgcgacattgactaacgctcactacgttcgggtccgaacgggaaccgg

SEQ ID NO: 365952 - DNA, 549 bp, Homo sapiens
  misc_feature: GZ8MTXP01DB6UY.10.38.D05.1.454.CMB.2.raw
  modified_base (243)..(243): a, c, t, g, unknown or other
  modified_base (270)..(270): a, c, t, g, unknown or other
  modified_base (288)..(288): a, c, t, g, unknown or other
  modified_base (338)..(338): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccaggggaagggctggagtgggtctcagttatgaaacngatggcactacatattatctgactcgngaagggccgttcaccctntccagagacacttccaacaacatcttgtatcttcacatgcacaatctganagtcgaacgacaacggccaacctattacttgtgcgcgacatgactacgctcaattcgtggggccagggacgcccgagtcaaccgtcctccccgacgccctaccaccgaacgggccccagtccggtccttcccccgtggccgccctgcctccgaggacgccaccgtccgacgcgccgaacacggccggcccgtggggcttcggccgttcggg

SEQ ID NO: 365953 - DNA, 558 bp, Homo sapiens
  misc_feature: GZ8MTXP01AE8WC.10.38.D05.1.454.CMB.2.raw
  modified_base (217)..(217): a, c, t, g, unknown or other
  modified_base (237)..(237): a, c, t, g, unknown or other
  modified_base (262)..(262): a, c, t, g, unknown or other
  modified_base (342)..(342): a, c, t, g, unknown or other
  modified_base (350)..(350): a, c, t, g, unknown or other
  modified_base (368)..(368): a, c, t, g, unknown or other
  modified_base (381)..(381): a, c, t, g, unknown or other
  modified_base (447)..(447): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttatgaaacngatggcactacatattatcngactccgtgaagggccgttcacctntccagagacacttccaacaacatcttgtatcttcacatgcacaatctgagagtcgacgacacggccaaccctattatgtncgacgacntgactacgctcaattcgnggggccagggacncccgaggtcaccgtcctccccagccctaccaccgaacgggccccagtccggggtcccttcccccgnggcccgcccctggacctccgacgacgccaccgccgacgaacgcgacacgccggcccgtcggcgttcgccgtcggtcgaacggactaccttaccctaaccgttaacgtaacg

SEQ ID NO: 365954 - DNA, 581 bp, Homo sapiens
  misc_feature: GZ8MTXP01C07SR.10.38.D05.1.454.CMB.2.raw
  modified_base (356)..(356): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctgggccccgccaggctccgagggggaaggggctgggagtggggtctcgagttattagaaacngactggcattacataattattctgactccggtagaacgggccggttacaccctctccagacgacacttacccaaactacattacttgtaactcttacatactcgacaactaatctacgagagtaccgacgacaaccggtccaccgttaattattggtcgcgaccgcaacgttcgttaacctccgctaacaacgtttcggacgggggtccccaaggggggaacccg

SEQ ID NO: 365955 - DNA, 545 bp, Homo sapiens
  misc_feature: GZ8MTXP01DSQZG.10.38.D05.1.454.CMB.2.raw
  modified_base (219)..(219): a, c, t, g, unknown or other
  modified_base (263)..(263): a, c, t, g, unknown or other
  modified_base (268)..(268): a, c, t, g, unknown or other
  modified_base (348)..(348): a, c, t, g, unknown or other
  modified_base (368)..(368): a, c, t, g, unknown or other
  modified_base (381)..(381): a, c, t, g, unknown or other
  modified_base (410)..(410): a, c, t, g, unknown or other
  modified_base (447)..(447): a, c, t, g, unknown or other
  modified_base (470)..(470): a, c, t, g, unknown or other
  modified_base (484)..(484): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttatgaaacngatggcactacatattatctgactccgtgacggccgttcacctncaganacacttcaacacatctgtatcttcacatgacacaatctgagagtcgacgacacgccaacccttattatgtgccgacgacntgaactacgctacaattcgnggggccagggacncccgaggtccacccgtcctccccagcccnccaccgaacggcccagttccggggtccctttccccgnggcccgtccctgcctccgaggcnccacctcgagaacncacgcgccgcccgtgggccttgcccgtgggtacaacggtcctaccttcccaacttcgtaag

SEQ ID NO: 365956 - DNA, 584 bp, Homo sapiens
  misc_feature: GZ8MTXP01DQ5FT.10.38.D05.1.454.CMB.2.raw
  modified_base (239)..(239): a, c, t, g, unknown or other
  modified_base (316)..(316): a, c, t, g, unknown or other
  modified_base (357)..(357): a, c, t, g, unknown or other
  modified_base (414)..(414): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttataactatgtctctggtaccagcaccaccagacaaacgccccaaactccttgttttgagtcagtaagcggcctnaggactccctgatcggttctctcgcctcaagtctgacaacncggccctccctgaccctctcgtacgggcctccgaggctggagatgaggctgattacnctgcagcgcagtacttcgacgaccccaagtagggttgttcgggcgggtacgggtacgtaaagggttcgaacccggttcgtcggggttaccacggccccgaaagggttccttcccggcccccgttacgggtccctacctcccgttccggttcccccgttccccgttaaccc

SEQ ID NO: 365957 - DNA, 647 bp, Homo sapiens
  misc_feature: GZ8MTXP01ATC1R.10.38.D05.1.454.CMB.2.raw
  modified_base (365)..(365): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccagcagtgacttttgtgcttataactatgtctcctgtaccagcaccaccagacaaacgccccaaattccttgtttgagtcagtaagcggcctgaggtacgtcctgtactcggttctctcgcctacaagtctggaaccaacnccggcctcccgtgacccgtctcgtcgggcctccgaggctaggacggatggaggtctagtacttacgtactgacgagccggtactaattacttaccgaaccggtaccccgaaaggtacggggttcggtttcggggccgggtaccggggtaacgttaaggggtccggtaacccggttccggtacgggggttaccacgggtaccccgaacgggttcccgttaccggtccccccgttcgggtccctacccgttcccgttaccgttccccgttaaccccgttccccg

SEQ ID NO: 365958 - DNA, 532 bp, Homo sapiens
  misc_feature: GZ8MTXP01AYSR5.10.38.D05.1.454.CMB.2.raw
  modified_base (392)..(392): a, c, t, g, unknown or other
  modified_base (510)..(510): a, c, t, g, unknown or other
  modified_base (526)..(526): a, c, t, g, unknown or other
tcagcatagtagtgcacgaccggtgctcgatttagtatctgatagttgggtttggggggtctcaggaggcagcgctctcaggacgtcacaaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccaccaggcaaacgccccaaactcttgttttgagtcagtaagccggcctcgaggacgtccctgacttcggtctctcgcctcaagtctggacaacgcgcctcctcgaccgtctcgtcgggcctcgngctgagatgaggctgacttactactgcagcggatattatcgacgcccaagtgggttgttggcgggcggtactagggtcgacgttccgtggcacggcccaggccttcgcccctggtccncgtccttcgttccccncctccc

SEQ ID NO: 365959 - DNA, 590 bp, Homo sapiens
  misc_feature: GZ8MTXP01BWVFH.10.38.D05.1.454.CMB.2.raw
  modified_base (436)..(436): a, c, t, g, unknown or other
  modified_base (471)..(471): a, c, t, g, unknown or other
  modified_base (500)..(500): a, c, t, g, unknown or other
  modified_base (536)..(536): a, c, t, g, unknown or other
  modified_base (544)..(544): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttcctgttgctattcaaaggtgtccactgtgaggttcaactggtggagactggaggaggctggatccagccgtggggggtccctgagactctcctgtgcagcctcgtgggttcagcatcagtaacgactacatcgaccgtcgggccccgccgagggcctaccggaagggggaacgggggctggggaggtgggtctcgtagttattagaaacgagatggacactacattaattacttctgtaccgtcccggtaggaacggggtcccgggttaccaccccttncccgaaggacacctaccttaccaaacatactcttnacttccttacacagggtcacaacaattcngacgtagccgacgaccaccgccacttaattcttgcncgactaanacgttcgactaacgctaacgacgtcgggacggggaaccgaagggcc

SEQ ID NO: 365960 - DNA, 571 bp, Homo sapiens
  misc_feature: GZ8MTXP01BQOM2.10.38.D05.1.454.CMB.2.raw
  modified_base (365)..(365): a, c, t, g, unknown or other
  modified_base (378)..(378): a, c, t, g, unknown or other
  modified_base (446)..(446): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccgagggaagggctggagtgggtctcagttattgaaacagatggcactacatattatctgactcgtgaagggccgttcaccctctccagagacacttccaacaacatcttgtatcttcacatgcacaatctgagagtcgacgacacggccactattattgtgcgcgaacatgactacgctcaattcgnggggccagggacncccgaggtccaccgtcctaccccagccctccaccgacgggcccagtccggtccttcccccgtggcccnccctgcctccgaggacgcctacccgtccgacgcgccacgacggcccggcccgtcggggccttcgggcccttgggtaacccaaacgggtcccttacccgtccccttaacttaaccgttaagtcggg

SEQ ID NO: 365961 - DNA, 601 bp, Homo sapiens
  misc_feature: GZ8MTXP01C7LBS.10.38.D05.1.454.CMB.2.raw
  modified_base (308)..(308): a, c, t, g, unknown or other
  modified_base (359)..(359): a, c, t, g, unknown or other
  modified_base (382)..(382): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccagccgtggggggtccctgagactctcctgtgcagcctcgtgggttcagcatcaagtaacgactaacatcgaccgtgggccccnccaggcctccgaggggaaggggctgggagtgggtctcgagttatagaaacngatggacactacataattattcngactccggtagaacgggccgttcaccctctaccagacgacaccttacccaaactaacctagttacctttagtacttccttacacattcgacaaaccatctagaacgagtaccgaacgtaccgaccggcctaaaccttaataagtttggcgccgtacgacttaagttcgaaccttaacgctcgtaagttccggttacgggggaacccaagggggaacccg

SEQ ID NO: 365962 - DNA, 588 bp, Homo sapiens
  misc_feature: GZ8MTXP01EESOW.10.38.D05.1.454.CMB.2.raw
  modified_base (217)..(217): a, c, t, g, unknown or other
  modified_base (261)..(261): a, c, t, g, unknown or other
  modified_base (266)..(266): a, c, t, g, unknown or other
  modified_base (283)..(283): a, c, t, g, unknown or other
  modified_base (348)..(348): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgagggaagggctggagtgggtctcagttatgaaacngatggcactacatattattctgactcgtgaaggccgttcacctncaganacacttcaacacatctntatctcacatgcacaatctgagagtcgacgacaccggccaaccctattattgtagccgacgaacngtcgaacctaacgctactaagttcgtacgggggcccaggggacgcccgacggtccacccggttccctccccgacgccctacccgaacccgaacgggccccaacgttccgggggtcccttcccccgtcggcccgcccctcgccctccgacggacgccacccgtccgacgaacgcacgacggccggcccgtggggccttcggccgtgggtcaacggtacctacttccctaacttaacgtaag

SEQ ID NO: 365963 - DNA, 615 bp, Homo sapiens
  misc_feature: GZ8MTXP01AHE2S.10.38.D05.1.454.CMB.2.raw
  modified_base (273)..(273): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcancagtaacgactacatcgacctgggccccgccaggctccgaggggaaggggctggagtgggtctcagttatgaaacagatggacacgtacattaattattctgaactccggtaggacgggtccggttcacccctctaccgaggacgaccaaccttaccaaacctaacattcctttagtacttcttacaaccattcgacccaataatccgttggaacgtacggtcccggaaacgaccgaccggaccctaacccttaattagttcggtacgccggtacgaacagttcgaaacccttcgtctaaccgtaaagtttcccggagggggtccccaagggggtaaccccg

SEQ ID NO: 365964 - DNA, 830 bp, Homo sapiens
  misc_feature: GZ8MTXP01CR4UE.10.38.D05.1.454.CMB.2.raw
  modified_base (275)..(275): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagcctcgtgggttcagcancaagtaacgactacatcgacccgtcgggccccgcgacggcctccggagggggaacgggggtcgtaggggaggttcggggtcctacgtaggtttaacttaaggaaacgagtaagtcggtacctaacttaacctaatttaaacttttaactttccgtacgtaaacccggttacccgggttaggggtaaacccgggggtcccccgggtttaccctaaacccccgttcccttaacccgaaggtaaaccgtaacccttaaaccctttaaccccaaaaccttaaacctaactttaccccgttttaaggtaactttccctttaacgaaacccgttagttaaccgtaaccctaaaccgtaaactttacccgttaagggaaaccggtacgggttaaacccggaaccccggaaaccgtaaaccccggggtaccccttaaacccgtttaaagttttaaccgttggttacggcccgtaaaccgtaacttaacgttcggttaacccttaaccggtaccttaacgtaaacggttcggttacccgggggaaccggaaggggtaaccccgg

SEQ ID NO: 365965 - DNA, 671 bp, Homo sapiens
  misc_feature: GZ8MTXP01A53Z2.10.38.D05.1.454.CMB.2.raw
  modified_base (350)..(350): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggtttcctgtgctattcaaaggtgtccactgtgaggttcaactggtggagactggaggaggctggatccagccgtggggggtccctgagactctcctgtgcagcctcgtgggttcagcatcagtaacgactacatgacctcgggccccgccaggctccgagggggaaggggctgggagtgggtctcgagttatagaaacngatggacactacattaaattacttctagtacctcccgggtaggtaaccggggtcccggttccaccccttcacccaagggacaacctaacctttacccaaaacctaacctagttcctttagtaacttccctttacaacctaaggggttcgactaaccaaactaccttacgaagtacggtaccggaaccgtaaccgaacccggaccccgtaacccttaacttaactttacggttggccgtaccggtaaccgagttcgaccgtaaccgtaccgttaacctaaacgttaccggttaccgggggtcccggaacggggtaacccggg

SEQ ID NO: 365966 - DNA, 656 bp, Homo sapiens
  misc_feature: GZ8MTXP01C0UAE.10.38.D05.1.454.CMB.2.raw
  modified_base (356)..(356): a, c, t, g, unknown or other
  modified_base (643)..(643): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggcccgcaggctaccgagggggacgggctgggaggtggtctcgagttatagaaaccngagtggacacgtaactattaattatctagtactccggtaggaaacggggtcccggttaccacccttcgtacccgagaacgtaacccacctttacccaaaactaactattaccttaggtaacttccttacgaaactagttacgaccaaacctaattcccgtaggaacggtaacgtcccggaaaccgtaccgaacccgggaaccttaacccgtttaaatttcgttcggtacggcgttaccgttacaagtaacgaaccgttaacgtcgtaaccgttaaggttttcccggnggggggaaccccg

SEQ ID NO: 365967 - DNA, 620 bp, Homo sapiens
  misc_feature: GZ8MTXP01AIZ18.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctgggccccgccaggctccgaggggaagggggctgggagtggggtctcgagttatagaaacagatggcactacattaaattattctgactccggtggaacggggtccggttccacccctctacccaggacacctaccttaccaaacaactattccttagttaacttccttacacctattcgacaacaacttcgtagaagtacgtaccggaaccgtacgaccggacctaaccttaatttacgttggtcgccgtcgaacttacgttcggaccttaacggccttaacgtaacgtttccggttacggggggtccccaagggggaaccccg

SEQ ID NO: 365968 - DNA, 637 bp, Homo sapiens
  misc_feature: GZ8MTXP01D4HAB.10.38.D05.1.454.CMB.2.raw
  modified_base (276)..(276): a, c, t, g, unknown or other
  modified_base (383)..(383): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctcgtgggtcagcancaagtaacgactacagtcgaccgtcgggccccgaccgacggcctaccggagggggaaacgggggcgtaggggtaggtcggggttctacgtagtttaattaggaaacngaagtcggacactacattaattacttcgtacgtaaccgttccggtacgggaaacggggtcccggttaccacccctcgtacccaaggtacgacctaaccttaacccaaaactactattcttagtaacttctacgacatcgactaacaattcgagacgagtaccgacgacaccgtacctactaattacttgcgcgacacagttcgaacttaacgcctaacgtaacgttcgggacggggaaccgaacggggaacccg

SEQ ID NO: 365969 - DNA, 525 bp, Homo sapiens
  misc_feature: GZ8MTXP01AH39D.10.38.D05.1.454.CMB.2.raw
  modified_base (301)..(301): a, c, t, g, unknown or other
  modified_base (346)..(346): a, c, t, g, unknown or other
  modified_base (423)..(423): a, c, t, g, unknown or other
  modified_base (443)..(443): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccncaggctccgaggggagggctgggagtgggtctcagttatgaaacngatggcactacataattatctgactcgtagaacgggccgttcaccctctccagagacacttaccaaacaacatcttntatcttcacatgcacaatcngagacgtacgacgacacggccactaattattgtcgcgcgacagttcgactaacgctaacaattcgcggggccaaggggaacc

SEQ ID NO: 365970 - DNA, 548 bp, Homo sapiens
  misc_feature: GZ8MTXP01DCUCV.10.38.D05.1.454.CMB.2.raw
  modified_base (350)..(350): a, c, t, g, unknown or other
  modified_base (499)..(499): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcagcctcgtgggttcagcatcaagtaacgactacatgacctggccccgcaggctccgaggggaggggctgggagtgggtctcagttatgaaacngactggacactacattaattattctgactccgtgaacgggccggttcaccctctcagacgacacttacccaaataacattcttgtactcttacacagtcgacaacaaatctagagagtacgaacgacaccggccaacttaattattgtncgcgaacagttcgacttaacgctcaattcgcggggcccgaagggaaccg

SEQ ID NO: 365971 - DNA, 633 bp, Homo sapiens
  misc_feature: GZ8MTXP01C50BM.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctgggccccgccaggctccgagggggaaggggctggagtggggtctcgtagttattgaaacagatggcactacataaattatctgactcggtgaacgggtccgttcaccctctccagacgacacttacccaacaacattccttgtatccttacactagttacgaccaactaaacttccgtaggaacggtacggttacccggaaacccgaaccgaacccgggccctaaacccgttaatttaagtttggtacggaccgtaccggaaccttagttcggaaccttaaccggacttaaccgtaaacgtttcgggttaccgggggtcccaacggggggtaacccc

SEQ ID NO: 365972 - DNA, 566 bp, Homo sapiens
  misc_feature: GZ8MTXP01AVM4T.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtggggggtccctgagactctcctgtgcagcctcgtgggtcagcatcagtaacgactacatgacctgggcccgccaggctccgaggggaggggctgggagtgggtctcgagttatagaaacagatggcacgtacataattattctgactccgtaggaacgggccggttcacccgtctaccagacgacaccgttaccaaacactatcttgtatcttcaacatgacacaatcctgagacgtacgacgaaccgcggacccaaccttaattattggtcgcgtacgaacagttcgaaccttaacggcctaactaagttccgttacgggggccaagggggcccg

SEQ ID NO: 365973 - DNA, 563 bp, Homo sapiens
  misc_feature: GZ8MTXP01EYMI5.10.38.D05.1.454.CMB.2.raw
  modified_base (513)..(513): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcaagtaacgactacatcgaccgtcgggccccgccaggctccgagggggaaggggctgggagtgggtctcgagttatagaaacagatggacactacataattattctgactccggtgaacgggtccgttcaccctctaccagacacacttccaaacactatcttgactcttacacatcgacaactaatcgtgagacgtacgacgaccacggccctaactaattattggtacgccgcgaacngttcgaccttaacgctaacgaagtttcggcgggggcccaagggggaaccc

SEQ ID NO: 365974 - DNA, 533 bp, Homo sapiens
  misc_feature: GZ8MTXP01CMR8Y.10.38.D05.1.454.CMB.2.raw
  modified_base (274)..(274): a, c, t, g, unknown or other
  modified_base (302)..(302): a, c, t, g, unknown or other
  modified_base (318)..(318): a, c, t, g, unknown or other
  modified_base (320)..(320): a, c, t, g, unknown or other
  modified_base (322)..(322): a, c, t, g, unknown or other
  modified_base (330)..(330): a, c, t, g, unknown or other
  modified_base (340)..(340): a, c, t, g, unknown or other
  modified_base (342)..(342): a, c, t, g, unknown or other
  modified_base (344)..(344): a, c, t, g, unknown or other
  modified_base (346)..(346): a, c, t, g, unknown or other
  modified_base (362)..(362): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaaggtgtccactgtgaggttcaactggtggagactggaggaggctggatccagcctgggggggtccctgagactctcctgtgcagcctctgggttcagcancagtaacgactacatgacctgggccccncagctcgagggagggngngngtggtctnagtatagaananangnactacataattatctnactcgtgaggacggtcacctctcacgagacactacaacaacatactgtatactctacagtagcacaactactcgtagagtacgacgacgaccgaccgacctaacttattgtgcgcgacgacgacgacgtaacgtactctaactacgttacgggtccgggaacgggaacggg

SEQ ID NO: 365975 - DNA, 557 bp, Homo sapiens
  misc_feature: GZ8MTXP01A6JSU.10.38.D05.1.454.CMB.2.raw
  modified_base (261)..(261): a, c, t, g, unknown or other
  modified_base (352)..(352): a, c, t, g, unknown or other
  modified_base (537)..(537): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctntgggttcagcatcagtaacgactacatcgacctgggccccgccaggctccgaggggaaggggctgggagtgggtctcgagttattgaaacngatggcactacataaattattcgtgtacctccggtaggaacggggtcccggttccaccctctccagacgacacttaccaaacaactatcttgtactcttcactatcgctaacaattctgagagtacgacgacaccggcccacttaattagttgtgcgtcgacattcggactcgctctaagttcgngggggcccaaggggaacccg

SEQ ID NO: 365976 - DNA, 608 bp, Homo sapiens
  misc_feature: GZ8MTXP01CK56X.10.38.D05.1.454.CMB.2.raw
  modified_base (173)..(173): a, c, t, g, unknown or other
  modified_base (220)..(220): a, c, t, g, unknown or other
  modified_base (241)..(241): a, c, t, g, unknown or other
  modified_base (359)..(359): a, c, t, g, unknown or other
  modified_base (368)..(368): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccnccaggctccgaggggaaggggctggagtgggtctcagttatgaaacngatggcactacatattattcngactccgtgaacgggtccgttcaccctctccagacgacacttccaaacaacatcttgtatcttcacatgacaacaatctagagagtccgaacgacacggcctaacccttattagttgngcgacgacntgaacctacgctacgaaactttcggacggggacccaaggggacgacccgacggtacccaccccggtccctacccccacgtcccctacccgaacccgaaaccgggcccctaacgttcccgggggttcccttcccccgtggcccgtccctcgccctccgacggacgccacctccgagaacgccacgacgccgcccgtggccgttcgccgtggacaacggcctaccttcccaacttaacgtcg

SEQ ID NO: 365977 - DNA, 612 bp, Homo sapiens
  misc_feature: GZ8MTXP01AQT7G.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtgggccccgccaggcctccgagggggaggggctgggagtgggtctcgagttatagaaacagatggacactacattaattattctgactcggtagaacgggtccggttcacccctctccagacgacctaccttaccaaacaactattcttagtactcttacacagtcgaccaactaatctggaagtacggtaccgaacgaccaaccgggtccctaaacgttaatttaacgttggtcgccggtacgtaacacgttcggaaacccttaaccggtctaacgtaagttccgggttacgggggaacccaagggggaaccccg

SEQ ID NO: 365978 - DNA, 616 bp, Homo sapiens
  misc_feature: GZ8MTXP01BROGE.10.38.D05.1.454.CMB.2.raw
  modified_base (240)..(240): a, c, t, g, unknown or other
  modified_base (309)..(309): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtncttataactatgtctctgtacagcaccaccagcaaacgccccaaatcttgtttgagtcagtagcgcctnaggacgtcctgactcggtctctcgcctcaagtctggaacaacgcggcctccctgaccgtctcgtgggcctcgagctgacgatggagctagacttacacgtgacagcggacattacttaccgaacggccccaaacggtagggggttcggtttcggggaccggggtacgggtaacgtaacgggtcggtacccggttccgggtcggggttaccgacggtaccccgaagggttcccgttcccgggtccccccgttcgggtaacctaaacttccccggttacccgtttccccccggttccccgtttcccccg

SEQ ID NO: 365979 - DNA, 610 bp, Homo sapiens
  misc_feature: GZ8MTXP01DZRWV.10.38.D05.1.454.CMB.2.raw
  modified_base (302)..(302): a, c, t, g, unknown or other
  modified_base (347)..(347): a, c, t, g, unknown or other
  modified_base (455)..(455): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcacgcctcgtgggttcagcatcagtaacgactacatcgacctggcccncagctcgaggggagggctggagtgggtctcgtagttatagaaacngatggacaactacattaaattattcgtgtaccgtccggtaggaaccggggtccgttaccaccccgtctacccgaagtacacctaccttaccaaactaactattcgttntactccttacactagtcactaactaatcgtaggaacgacgtaccgaaccgaaccgaccggccctaacttaagttagttcggcgccgacgtaacagttcggttacctaaccgtctaacgtaacgttccgggacgggggcccaagggggtaaccccg

SEQ ID NO: 365980 - DNA, 549 bp, Homo sapiens
  misc_feature: GZ8MTXP01A8DYO.10.38.D05.1.454.CMB.2.raw
  modified_base (243)..(243): a, c, t, g, unknown or other
  modified_base (358)..(358): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacngatggcactacatattattctgactccgtgaagggccgttcaccctctccagagacacttccaacaacatcttgtatcttcacatgcacaatctgagagtcgacgacaacggccnctattatgtgcgcgacatgactacgctcaattcgtggggccaggggacgccccaggtccaccgtcctccccgagccctccaccgaacgggccccatccggtccttcccccgtggcccgccctgcctcccgaggacgccacccgtcccggagcgccaacacggccggccccgtggggcctcggcccgtcggg

SEQ ID NO: 365981 - DNA, 576 bp, Homo sapiens
  misc_feature: GZ8MTXP01BNKPB.10.38.D05.1.454.CMB.2.raw
  modified_base (517)..(517): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtgggttttcctgttgctatttcaaaaggtgtccactgtgaggttcaactggtggagactggaggaggctggatccagccgtggggggtccctgagactctcctgtgcagcctcgtgggttcagcatcagtaacgactacatcgacccgtgggccccgccaggcctccgaggggaagggggctgggagtgggtctcgagttatagaaacagatggcactacattaattattctgaccgtccgtaggaacgggtccggtcacccctctccagacgactaccttacaaacactattccttagtacttcttacacctatcgactacaagttcagagacggtacgaacgtaccaccggtaccctacttaattnttggcgcgaccattacgttcgacctcgctaactagttcggacggggccaaggggaaccc

SEQ ID NO: 365982 - DNA, 588 bp, Homo sapiens
  misc_feature: GZ8MTXP01CVT6X.10.38.D05.1.454.CMB.2.raw
  modified_base (303)..(303): a, c, t, g, unknown or other
  modified_base (355)..(355): a, c, t, g, unknown or other
  modified_base (414)..(414): a, c, t, g, unknown or other
  modified_base (470)..(470): a, c, t, g, unknown or other
  modified_base (480)..(480): a, c, t, g, unknown or other
  modified_base (536)..(536): a, c, t, g, unknown or other
  modified_base (542)..(542): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgaccgtgggccccnccgaggctccgagggggaagggctgggagtgggtctcgtagttatagaaacngatggacactaacattaaattattctgacttccggtagaacgggcccgttcacccgttntacccaaggtacgaccaccttacccaaactaaactcttcttagtactcttacaacntcgacctaanaaacgtctagaagtacgtaccgacgaccacggccctaaaccgtaattacttggtcncggacnaagttcgactaacgcttaacaatttcggcgggaacccgaagggccc

SEQ ID NO: 365983 - DNA, 511 bp, Homo sapiens
  misc_feature: GZ8MTXP01EJ70U.10.38.D05.1.454.CMB.2.raw
  modified_base (241)..(241): a, c, t, g, unknown or other
  modified_base (311)..(311): a, c, t, g, unknown or other
  modified_base (390)..(390): a, c, t, g, unknown or other
  modified_base (414)..(414): a, c, t, g, unknown or other
  modified_base (495)..(495): a, c, t, g, unknown or other
  modified_base (509)..(509): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttataactatgtctctgtacagcaccaccagcaaacgccccaaatccttgtttgagtcagtagcgcctnagacgtcctgatcggttctctcgcctcaagtctggaacaacgcgcctcatcgaccgtctcgtgggctcgaggctgaggntaggagctgattacactgcaggcnctatatcgacgcccaagcgggtgttggcggcggataaggtcgaccgtcgttgggcacgcccgaggcctcgcccctggtccncttctccgttcccncc

SEQ ID NO: 365984 - DNA, 565 bp, Homo sapiens
  misc_feature: GZ8MTXP01EGO8Q.10.38.D05.1.454.CMB.2.raw
  modified_base (353)..(353): a, c, t, g, unknown or other
  modified_base (509)..(509): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcaagtaacgactacatcgaccgtgggccccgccaggctccgaggggaaggggctgggagtgggtctcgagttatgaaacngatggacatacattaaattattctgactccggtagaacgggccggttcaccctctaccagagaccacttaccaaacaactattcttagtactcttacacattcgactaacaatctagaagacgtaccgacgacaccggtccaacgtaattattgtnccgtacgacagttcgaactcgctaacgtaatcggttaggggcccaagggggaaccc

SEQ ID NO: 365985 - DNA, 671 bp, Homo sapiens
  misc_feature: GZ8MTXP01A1IXF.10.38.D05.1.454.CMB.2.raw
  modified_base (361)..(361): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacccgtgggccccgccacgggcctccgagggggaaggggctgggaggtgggtctcgagttatagaaacngactggacactacattaattattctgaccttccggtaggaacggggtcccgttcacccctctaccgaagacgacctaccttaccaaactactacttcttagtacttccttacaactagttacgacctaacaaacttccgtaggaacgtacggttacccggaaccgaacccgtacccgggtccccttaaacccgttaattttacgtttcgggtacggaccgtaccggtaacttacgttcgaacccgttaacccggcttaaccgtaaacgtttcccggggacgggggtaaccccgaagggggtaacccccgg

SEQ ID NO: 365986 - DNA, 559 bp, Homo sapiens
  misc_feature: GZ8MTXP01BN428.10.38.D05.1.454.CMB.2.raw
  modified_base (318)..(318): a, c, t, g, unknown or other
  modified_base (356)..(356): a, c, t, g, unknown or other
  modified_base (374)..(374): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacagatggcactacatattattctgactccgtgaacgggccggttcaccctctccagagacacttccaacaacatcttgtatcttcacatgcacaatctganagtcgacgacacggcacccctattattgtgccgcgacntgactacgctcaattcgnggggccagggacgcccgaggtcacccgtcctccccacgccctccaccgaacgggcccactcgggggtccttcccccgtcggccgccctcgcctccgaggacgcaccctccgacgcgcacacggccggtcccgtgggccttcggaccctcgggtcaacggtcctaccttcccaacttaaccgtaag

SEQ ID NO: 365987 - DNA, 575 bp, Homo sapiens
  misc_feature: GZ8MTXP01CKN24.10.38.D05.1.454.CMB.2.raw
  modified_base (273)..(273): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcancagtaacgactacatgacctgggccccgccaggctccgaggggaaggggctgggagtgggtctcgagttatgaaacagactggcactacattaattattctgactccggtaggaacgggtcccggttcaccctctcccgagacgaccacttacccaaacactatcttagtactcttacacatcgacacaatctgacgagtaccgacgaccacggccctaaccttaatttagttggtcgccgtacgacagttcgacctaaccgctaacgaacgtttcggacgggggccccaagggggaacccg

SEQ ID NO: 365988 - DNA, 560 bp, Homo sapiens
  misc_feature: GZ8MTXP01AF0QW.10.38.D05.1.454.CMB.2.raw
  modified_base (273)..(273): a, c, t, g, unknown or other
  modified_base (348)..(348): a, c, t, g, unknown or other
  modified_base (376)..(376): a, c, t, g, unknown or other
  modified_base (450)..(450): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcancagtaacgactacatgacctgggccccgccaggctccgaggggagggctggagtgggtctcgagttatagaaacngatggcactacataattatctgactcgngacgggtccgtcaccctctccagacgactacttaccaaacactattcttagtatccttcactaggtcacctaanaaacgttcctggagacgtacgacgacaccggccaccgtaattacttggtcgccgacgtacagttgaacctaacgctaacgtaacttcggcggggccgaagggggaacccg

SEQ ID NO: 365989 - DNA, 631 bp, Homo sapiens
  misc_feature: GZ8MTXP01A0GT4.10.38.D05.1.454.CMB.2.raw
  modified_base (427)..(427): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagcctctgggttcagcatcaagtaacgactacatcgaccgtcgggccccgcgacggcctaccgagggggaacgggggcgtgggaggtggggtctcgtagtttatagaaacagatggacactacattaattattctgactccggtaggaacgggtccggttaccacccctntaccaagacgacctacttacccaaacactattccttagacttctactacgatcgacaacattccgtagacgtacgtacgaaccgacgaccggtcctaaccgttaatttacgttcggtacgccgggactaaccgttagttcggaaccctaacgtcctaacgtaaacgttccgggttacggggggaacccaaggggggtaaccccg

SEQ ID NO: 365990 - DNA, 539 bp, Homo sapiens
  misc_feature: GZ8MTXP01C7DI2.10.38.D05.1.454.CMB.2.raw
  modified_base (302)..(302): a, c, t, g, unknown or other
  modified_base (352)..(352): a, c, t, g, unknown or other
  modified_base (364)..(364): a, c, t, g, unknown or other
  modified_base (404)..(404): a, c, t, g, unknown or other
  modified_base (410)..(410): a, c, t, g, unknown or other
  modified_base (423)..(423): a, c, t, g, unknown or other
  modified_base (427)..(427): a, c, t, g, unknown or other
  modified_base (432)..(432): a, c, t, g, unknown or other
  modified_base (456)..(456): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttcctgtgctattcaaaggtgtccactgtgaggttcaacgtggtggagacgtggaggaggctggatccagccgtgggggtcctgagactctcctgtgcagcctcgtgggttcagcatcaagtaacgactacatcgaccgtgggccccncaggcctcgaagggggaggggctgggagtgggtctcgagttatagaaacngatggacactanattaattatctgactccgtagaacgggtcgttcactctcncaaganacacttaccaaanaacngtctntactctacactagtcacacaatanagagacgacgtacgacgacgactaactattatgttcgcgacgacgcacgaactactctacgtacgttacgtcgggcggaacgg

SEQ ID NO: 365991 - DNA, 601 bp, Homo sapiens
  misc_feature: GZ8MTXP01EMGZJ.10.38.D05.1.454.CMB.2.raw
  modified_base (277)..(277): a, c, t, g, unknown or other
  modified_base (546)..(546): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctcgtgggttcagcancaagtaacgactacatcgaccgtcgggccccgccgacggcctccggaagggggaaggggcgtgggaggtgggtctcgtagttatagaaacagatggcaactacattaattattctgtactccgtaggaacgggtccggttccaccctctacccgagacgtacctaccttacccaaaacaactattccttagtaacttccttacaacctagtcgaccaactaatcgtagaacgtcgtacgacgtacaccggcctacttaattagttggancgacgacagttcgactcgctaaccgtaagttccggagggccgttaagggaacccg

SEQ ID NO: 365992 - DNA, 550 bp, Homo sapiens
  misc_feature: GZ8MTXP01E2GKB.10.38.D05.1.454.CMB.2.raw
  modified_base (445)..(445): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggtcagcatcagtaacgactacatgacctgggccccgccaggctccgaggggaagggggctgggagtgggtctcgagttatgaaacagatggcactacataattattctgactccgtgaacgggccggttcaccctctcccagacgacacttccaaacaactatcttgtactcttcacagtnacacaaatctgagagtacgacgtacacggacccaacctaattaagttgtgcgacgaacagttcgaccttaacgctaacaattcggcggggccgaaggggaacccg

SEQ ID NO: 365993 - DNA, 661 bp, Homo sapiens
  misc_feature: GZ8MTXP01C9H1U.10.38.D05.1.454.CMB.2.raw
  modified_base (360)..(360): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatcgaccgtcgggccccgccagggctccgagggggaaggggctgggagtgggtctctagttattagaaacngaatggactaactaacattaaatttaacttctacgtaccgttacccggtaggtaaaccggggtccccgggtttacaaccccgttctaccgaagacgaaccctacttacccaaaacctaagtacttcctttagaacttccttacaaacctagggtacgaacctaacctaaagttccaggaagtacgtaccgaacgtaacacccgggacctacctaatttacgttcggtcgcgacgtaacttattcggaaaccttcggacttaaccgtaaattccgggacggggtaaccgaacgggggaaccc

SEQ ID NO: 365994 - DNA, 536 bp, Homo sapiens
  misc_feature: GZ8MTXP01C38UV.10.38.D05.1.454.CMB.2.raw
  modified_base (371)..(371): a, c, t, g, unknown or other
  modified_base (384)..(384): a, c, t, g, unknown or other
  modified_base (459)..(459): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttatgaaacagatggcactacatattatctgactccgtgaagggccgttcaccctctccagagacacttccaaacaacatcttgatcttcacatgcaacaatctgagagtcgacgacacggccaccctattatgtgcgcgacaatgactaacgctcaattcngggtccagggacncccaggtcaccgtctcccagcctccaccaacggcccatcgggtcttcccctgcgccctgcctccacgacgcaccnccgacgaacgcacacgcggcccgtcgggcgttcgccgtcggtacgaacggacgtacttaccctaaccttaactaacg

SEQ ID NO: 365995 - DNA, 579 bp, Homo sapiens
  misc_feature: GZ8MTXP01C52LX.10.38.D05.1.454.CMB.2.raw
  modified_base (371)..(371): a, c, t, g, unknown or other
  modified_base (390)..(390): a, c, t, g, unknown or other
  modified_base (410)..(410): a, c, t, g, unknown or other
  modified_base (435)..(435): a, c, t, g, unknown or other
  modified_base (441)..(441): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggttttcctgttgctatttcaaaaggtgtccactgtgaggttcaactggtggagactggaggaggctggatccagccgtggggggtccctgagactctcctgtgcagcctctgggttcagcatcaagtaacgactacatcgaccgtcgggccccgccaggcctccgagggggaaggggctgggagtggggtctcgagttatagaaacagactggacactanattaattattctgactcgngaacgggtccgttcaccctntccgagacgacacttaccaaacacnttcttntatcttacacgagtcacaacctaatctagagacgtaccgaacgaccaccggtaccctaacttaatttacgttgtcgaccgcgaacattcggaccttaacggctaacgtaattccgggacggggccaagggggaacccg

SEQ ID NO: 365996 - DNA, 636 bp, Homo sapiens
  misc_feature: GZ8MTXP01DSHPD.10.38.D05.1.454.CMB.2.raw
  modified_base (357)..(357): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctcgtgggttcagcatcaagtaacgactacatgacctgggccccgcaggctccgaggggaaggggctgggagtgggtctcgtagttattagaaacngatggacaactacattaaattattccgtagaccgttccggtaggaaacggggtccccggttacaacccccttctacccgaaggacgaaccctaacctttaccccaaaactaaacctattcctttagtaacttccttacaactagtcgtaccaataaactcgtagacgacgttaccgaaccgtaccacggtcccctaacttaattacgttgcgccgtacgacttaagttcgaacctaaccgcttaacaagtttccggagggggtccccaagggggaaccc

SEQ ID NO: 365997 - DNA, 586 bp, Homo sapiens
  misc_feature: GZ8MTXP01C4K0V.10.38.D05.1.454.CMB.2.raw
  modified_base (276)..(276): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcagcctcgtgggttcagcancagtaacgactacatgacctgggccccgccaggctccgagggggaagggctgggagtgggtctcagttatagaaacagatggcactacataattatctgactcgagacgggccgtcaccctctccagacgacacttaccaaactacatcttagtactcttacactaggtctaacacaaagtcctaggacgtagtccggaaccgtaccgaccggtaccctaaccgttaatttaacgttggtcgccgtacgaaccttagttcgaacctcgacttcgaaacgtttcggacgggggtcccaaggggtaaccccg

SEQ ID NO: 365998 - DNA, 532 bp, Homo sapiens
  misc_feature: GZ8MTXP01EF4JR.10.38.D05.1.454.CMB.2.raw
  modified_base (301)..(301): a, c, t, g, unknown or other
  modified_base (351)..(351): a, c, t, g, unknown or other
  modified_base (370)..(370): a, c, t, g, unknown or other
  modified_base (400)..(400): a, c, t, g, unknown or other
  modified_base (494)..(494): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgaggggtccctgagactctcctgtgcagcctctgggttcagcatcagtaacgactacatgacctgggccccncaggctccgagggggaaggggctgggagtgggtctcgagttatagaaacngatggcactacaattattntctgactccgtgacgggtccgttcaccctntccagacacacttaccaaacaactatcttgtattcttcacgatgacacaatctgagacgtcgacgacacgccaacttattatgttcgcgcgacnttcgaactacgcttacaagttccgtggggcccaagggg

SEQ ID NO: 365999 - DNA, 667 bp, Homo sapiens
  misc_feature: GZ8MTXP01EKUYT.10.38.D05.1.454.CMB.2.raw
  modified_base (277)..(277): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaaggtgtccactgtgaggttcaactggtggagacgtggaggaggctggatccgagccgtgggggtccctgagactctcctgtgcagcctcgtgggttcagcancaagtaacgactaacatcgacccgtcgggcccccgaccgagggcctcccggaagggggaacgggggcgtagggtaggttcggggtactcgtaagtttaattagaaaacagaagttggactaactacaatttaaattacttcgtagtacccttccgggtaggtaaaccggggtcccggttaccaccccttctaccgaaggacacctaccttaccaaaacaactattcttatactcttacactagtcaacactaatcgtagaacgtagtaaccgacgaaccgaccggtaccctaaccttaatttacgttggacgccggacgtaacttacggttcaaccgtaacgaccttaacgtaacggtttccggacgggggtccccgaaagggggtcccc

SEQ ID NO: 366000 - DNA, 666 bp, Homo sapiens
  misc_feature: GZ8MTXP01DPXQL.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggtcagcatcagtaacgactacatcgaccgtcgggccccgccgaggcctccgagggggaaggggcgtgggaggtgggtctcgtagttatagaaacagatggacaactaactattaaatttaattcgtacgtaccgtacccggtaggaacggggtcccggttccaccccgttctaccgaagacgacctaccttacccaaaactaactattccttagttactacttaccaactattcgacctaactaatcgtagaacgtacggtaccgaaccgtaccgaaccgggtacccctaaccttaatttacgttgggtacgccggtaccgaacttacgttacggacccttaaaccggccttaacgtaacgtttccgggacgggggtaaccccgaagggggtaaccccg

SEQ ID NO: 366001 - DNA, 561 bp, Homo sapiens
  misc_feature: GZ8MTXP01A7425.10.38.D05.1.454.CMB.2.raw
  modified_base (517)..(517): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtcccctggacgactctcctgtgcagcctcgtgggttcagcagtcaagtaacgactaacatcgaccgtcgggccccgccgaggcctccgaggggaaggggcgtgggagtggggtctcgaggttattagaaacagatggcactacactaattattctgactccgtagaacgggtccggtacacccgtctaccagacactactcaaacacatctgtatctacacatcgactacatactgagacgtacgacgacgacgaccaccttaattacttgtgcgacgaacngttcactaacgctaacaacttcgcggggtcccaaggggaacccg

SEQ ID NO: 366002 - DNA, 590 bp, Homo sapiens
  misc_feature: GZ8MTXP01AOVIJ.10.38.D05.1.454.CMB.2.raw
  modified_base (505)..(505): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctctgggttcagcatcagtaacgactacatcgacctgggccccgccaggctccgagggggaggggctgggagtgggtctcgtagttatagaaacagatggcactacataattatctgactccgtggaacgggtccggttcaccctctcagacgacacttaccaaacaacagttcttgtactcttacacattcgactactaagtcctggaacgagtaccgaacgtaccgaccggtaccctaaccgttnttaacgttgtcgcggtaccaacttacttcggacctaacgtccttaacgtaaacgttcggttacgggggcccgaaggggaaccccg

SEQ ID NO: 366003 - DNA, 726 bp, Homo sapiens
  misc_feature: GZ8MTXP01CLTUQ.10.38.D05.1.454.CMB.2.raw
  modified_base (725)..(725): a, c, t, g, unknown or other
tcagcatagtagtgcacgaccggtgctcgatttagtatctgatagttgggtttggggggaagaggaagactgagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaacgtttcgtgggggccagggggacgcccccgtaagggtcccaaaccccggttccctcccccgacggccccctacccgaaaccccgaaacgggggcccccaacgttcccgggttcccctttcccccccgtcgggccccgtcccccgtttcggccccgttaccccgaacggggacgacccctaaccccgtaccccggaacggggacggcccgaaccgaaccgggccccgggcccccggttcgggggcccgttcggccccgttcggggttacccgaaacgggtaccctttaacccctttcccccgaaactttaccgttaacgttcgggaccgttacgggacgggttcccgggggtccgttcggggaaccgaaacggggccggaccaacgttaaggng

SEQ ID NO: 366004 - DNA, 603 bp, Homo sapiens
  misc_feature: GZ8MTXP01DJ1AH.10.38.D05.1.454.CMB.2.raw
  modified_base (362)..(362): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctgagactctcctgtgcagcctcgtgggttcagcatcagtaacgactacatcgaccgtcgggccccgccgaggcctccggagggggaaggggcgtgggaggtgggtctcgagttatagaaacngactggacactactattaattattctgtacctccggtaggaacggggtccgttacaccctctaccagacgacctacttacccaaactaactattccttatacttcttacaactacgtcgaactaactaatcgtagagacgtacgactacacggccacttaattagttcgtcgcgacgtacacgttcgttacctaaccgctaacgtaacgttcggttcggggaacccgaagggggaaccccg

SEQ ID NO: 366005 - DNA, 590 bp, Homo sapiens
  misc_feature: GZ8MTXP01AH01P.10.38.D05.1.454.CMB.2.raw
  modified_base (490)..(490): a, c, t, g, unknown or other
  modified_base (553)..(553): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctgtgggttcagcatcagtaacgactacatcgaccgtgggccccgcagggctccgaggggtaaggggctgggagtgggtctcgaagttattcgaaacaggtatggacaactaactattaaatttaacttcctaggaccctccggtaggaacgggtccgttacacccgtctacgaagacaccaccttacaaacaacacgttctagtactcttacacgatcgactaccaattcngagacgtcggaacctacgaccggacctaccttaatacgttgacgcgacgaacattcgaactcncttaacaacgttcggaggggtcccaagggggaacccc

SEQ ID NO: 366006 - DNA, 550 bp, Homo sapiens
  misc_feature: GZ8MTXP01AI88H.10.38.D05.1.454.CMB.2.raw
  modified_base (409)..(409): a, c, t, g, unknown or other
  modified_base (457)..(457): a, c, t, g, unknown or other
  modified_base (468)..(468): a, c, t, g, unknown or other
  modified_base (490)..(490): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccgagggcctccgagggggaagggggctgggagtgggtctcgagttattgaaacagatggcactacataattatctgactcgtagacgggccgttacaccctcnccagacgacacttcaaacactatcttgactctacacatcgcacaatcngagagtcgacnccacgcctactaattattgtcncgacgacttagttcggacctaacgctaacgtaacgttcgacggggccaagggggaacccg

SEQ ID NO: 366007 - DNA, 714 bp, Homo sapiens
  misc_feature: GZ8MTXP01DLKR3.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccaggccgtggggggtccctgagactctcctgtgcacgcctcgtggggttcagcatcagtaacgactaacatgaccctgggccccgccaggctccggagggggaagggctgggagtgggtctcgagtttattagaaacagactggactaactacattaaactttatttcgtagtacccgttccgggtacggaaacggggtccccgggttacaccccttcctaccgaaggacgaacctaccttacccaaaactaaacctattacctttagtaacttcctttacaacctaagttacgacctaaacctaaacttccgttaggaacggacggttaacccggaaaccgaaccgtaacccgggaccccttaacccgtttaaatttacgtttcgggttacggaccggtaaccgtaacaacggttcgttaaaccgttaaccggaccttaacgttaaacgtttccgggacggggggtaacccgaacgggggtaaccccgg

SEQ ID NO: 366008 - DNA, 650 bp, Homo sapiens
  misc_feature: GZ8MTXP01B68EO.10.38.D05.1.454.CMB.2.raw
  modified_base (273)..(273): a, c, t, g, unknown or other
  modified_base (360)..(360): a, c, t, g, unknown or other
  modified_base (504)..(504): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccgaggggaagggctggagtgggtctcagttattgaaacagatggcactacattattattctgactccgtgaacgggtccgttcaccctctcaganacactccaacaacatcttgtattctcacatgacaacaatctgaagacgtcgaacgacgacggccaaccttattattgtgccgcgaanatgactacgctacaagttcggcggggcccgaggggcacccgtacggtccacccggtccctaccccacgccctacccaccgaaccgggcccacgttcccggtcccgttcccccgtggccctccccgtcgcctcccgagggaaccncccgtaacccgtccggaacgcggcccgaacgccggggccccggttcccggtcgggggtccttccgggttcccgttacgggttaacccgaaaccgggtaacccctttaacccgttccccgttaaaccttaaccgttaacgttcccgg

SEQ ID NO: 366009 - DNA, 601 bp, Homo sapiens
  misc_feature: GZ8MTXP01CRNB4.10.38.D05.1.454.CMB.2.raw
  modified_base (490)..(490): a, c, t, g, unknown or other
  modified_base (550)..(550): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcatcagtaacgactacatcgacctgggccccgccaggctccgagggggaagggggctgggagtgggtctcgtagttattagaaacagactggacactacattaattattctagaccttccggtaggaacgggtcccggttccacccgtctaccgaaggacgaacctaccttacccaaactaactacttacttgtaacttcttaccaatactgaccaanaaactctaggagacgtacgaccgtaccacggccctaacgtaattagttcgcgccgcgaanacgttgacctaacgctaacaagtttccggaggggcccgaaggggtaacccg

SEQ ID NO: 366010 - DNA, 620 bp, Homo sapiens
  misc_feature: GZ8MTXP01CHZKO.10.38.D05.1.454.CMB.2.raw
  modified_base (304)..(304): a, c, t, g, unknown or other
  modified_base (381)..(381): a, c, t, g, unknown or other
  modified_base (464)..(464): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacatcgacccgtgggccccnccgaggcctccgagggggaaggggctgggagtgggtctcgagttatagaaacagactggcactacattaattattcngaccgtccgtggaacgggtcccggttcacccgtctaccgagtacgactaccttaccaaacaactactcttagtacttccttanacctatcgaccaacaatcgtagacgtacgtaccgaccgaaccgaccggaccctaacttaatttacgttcggcgccggtactacaacgttcggaaaccctttaacggaccttaacgtaaacggttccggttacgggggccccaagggggtaaccccg

SEQ ID NO: 366011 - DNA, 567 bp, Homo sapiens
  misc_feature: GZ8MTXP01AWFN5.10.38.D05.1.454.CMB.2.raw
  modified_base (304)..(304): a, c, t, g, unknown or other
  modified_base (355)..(355): a, c, t, g, unknown or other
  modified_base (374)..(374): a, c, t, g, unknown or other
  modified_base (524)..(524): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctggggttcaggcatcagtaacgactacatgacctgggccccnccagggctccgaggggaagggggctgggagtgggtctcgagttatgaaacngatggcatacataattatngactccgtgaaggggtccgttcaccctctcccgagacgaccacttccaaacaacatccttagtaactcttacgaactattgcaactaaatcctgaagtacgtacgaccgaacaccgggacccaaccgtaattaattggcgacgccgaaanagttcgaactaacgctaacgagttcggacgggccgaagggccg

SEQ ID NO: 366012 - DNA, 649 bp, Homo sapiens
  misc_feature: GZ8MTXP01AFMH9.10.38.D05.1.454.CMB.2.raw
  modified_base (266)..(266): a, c, t, g, unknown or other
  modified_base (286)..(286): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcgttgggttttccttgttgcttatttacaaaggtgtccactgtgaggttcaacgtggtggagacgtggaggaggctggatccgaggccgtcgggggtccctgagactctccgtgtgcncgtcctcgtgggttcagcancaagtaacgactacagtcgaccgtcgggccccgccgacggccgtccggaaggggggacgggggcgtgggaggtcggggtcctacgtagtttatagaaacgagtacgtcggactaactacatttaacttattcgtagtaccgtccgggtaggaaccggggtcccgttaccaaccccgtctaccgaaggaccaacctacccttaacccgaaactactattccttagtacttcttacactaggtcacaactaatctagacgtacgaccgacgtaccaccggtacctacttaatacttggcgcgacgaattcgttacaccgtaacgtctaacgtacgttccgggttacggggccaagggggtaaccc

SEQ ID NO: 366013 - DNA, 588 bp, Homo sapiens
  misc_feature: GZ8MTXP01AFSYV.10.38.D05.1.454.CMB.2.raw
  modified_base (356)..(356): a, c, t, g, unknown or other
  modified_base (411)..(411): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgaccgtgggccccgccaggctccgaggggaagggggctgggagtggggtctcgagtttatgaaacngactggcactacataattatctgactcgtagagggccgtcaccctctcagagacncttaccaacaacattcttagtatcttcacgatcgacacaactctggaagacgttaccggaacgtaccgaaccgggtcccaacccttaattaacgtttgtacggccgaccgtaaccgattcggttaacctaaccggcctcgtaaacttcgggttcggggaacccgaaggggtaacccg

SEQ ID NO: 366014 - DNA, 589 bp, Homo sapiens
  misc_feature: GZ8MTXP01ADS1A.10.38.D05.1.454.CMB.2.raw
  modified_base (362)..(362): a, c, t, g, unknown or other
  modified_base (547)..(547): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcaagtaacgactacatcgaccgtgggccccgccgaggcctccggaagggggaaggggctgggaggtgggtctcgagttatgaaacngactggacactaacattaaattattcgtgaacctccggtagacggggtcccggttccacccgtctaccgaagacgacctaaccttaccaaactaactacgttctttacgtaattccttacgacagttcgacacctaatctagagacgtcgacgacaccgcctacgtaattattgcgcgtacgacngttcgaactcgctaacaagttcggcggggccaaggggaaccg

SEQ ID NO: 366015 - DNA, 567 bp, Homo sapiens
  misc_feature: GZ8MTXP01ECKUO.10.38.D05.1.454.CMB.2.raw
  modified_base (375)..(375): a, c, t, g, unknown or other
  modified_base (468)..(468): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtgggccccgcaggcctccgaggggaagggggctgggagtgggtctcgagttatgaaacagatggcactacataattattcngactccggtgaacggggtccgttcacccctctccagacgacaccttaccaaacaacattccgttatactcttacacattcgactaacaattcngaacgacgtacgacgacacggaccaaccttaattaacttggtcgcgacgacagttgacctaacgctaacgaagtttcgcgggggcccaagggggaaccg

SEQ ID NO: 366016 - DNA, 707 bp, Homo sapiens
  misc_feature: GZ8MTXP01ASCTQ.10.38.D05.1.454.CMB.2.raw
  modified_base (362)..(362): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttccttgttgctatttcaaaaggtgtccactgtgaggttcaacgtggtggagactggaggaggctggatccagccgtggggggtccctgagactctctgtgcagcctgtgggttcagcatcagtaacgactacatcgaccgtgggccccgccgagggcctccggagggggaaggggcgtgggagtgggtctcgtagttaatagaaacngactggactactactattaaattactttcgtcgaaccgttcccgggtacgggtaaaccggggtcccgggtttaccaaccccctttcgtacccaaggtaaccgtaaccctaacccttaaccccaaaacctaaaacccttcgtttaccgtttacgtacctttaccttaaccaacgtacgtacgaacctaaacgtaacgtcgtaaggaacgtacggtaacccggaaccgtacccgtaacccggtaccttaaacgttaagttagttcggtacgccgtaccgtaacttacgttcgttacctaacgtcgtaacgtaacggttccggacggggtaaccgaacgggtaacccg

SEQ ID NO: 366017 - DNA, 733 bp, Homo sapiens
  misc_feature: GZ8MTXP01DQ1YR.10.38.D05.1.454.CMB.2.raw
  modified_base (274)..(274): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagcctcgtggttcagcancaagtaacgactacatcgaccgtcgggccccgccgaggccgtaccggaagggggaacggggtcgtgggaggtggggtctacgtagtttaagttagaaaacgagtaacgtcggactaactaactaattaaactttaacttccgtagtaacccgttcccgggtacgggtaaaccgggggtccccggtttacccaacccccgttctacccgaaggtaacgtaaccctaacctttacccaaaaactaactactttcctttagtaacttcctttaacaacctaagttcggaacctaaacctaaagttcctaaggaacggtaacggttacccggaaacccgtaaccgaaccccggtcccttaaacgttaagttttacgttggtcgaccggtacgaacttacgttcgaacccttaacgccttaactaacggttccggacgggggtaaccccgaagggggaaccccg

SEQ ID NO: 366018 - DNA, 550 bp, Homo sapiens
  misc_feature: GZ8MTXP01C8092.10.38.D05.1.454.CMB.2.raw
  modified_base (505)..(505): a, c, t, g, unknown or other
  modified_base (511)..(511): a, c, t, g, unknown or other
  modified_base (514)..(514): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaaggtgtccactgtgaggttcaactggtggagactggaggaggctggatccgagccgtgggggtccctgagactctcctgtgcagcctctgggttcagcatcagtaacgactacatgaccgtgggccccgccaggctccgagggggaaggggctgggagtgggtctctagttattagaaacagatggacactactattaattattctgacctccggtggaacgggtccggttcactctctccagacgactacttaccaacaactatcttgtactcttcagtatcgacacaatctagagacgtcgaacgacaccggccaaccttattattgngccgtnacnttgaacctagctacaagttcgtggggcccaaggggg

SEQ ID NO: 366019 - DNA, 595 bp, Homo sapiens
  misc_feature: GZ8MTXP01EFN2Z.10.38.D05.1.454.CMB.2.raw
  modified_base (362)..(362): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggtcagcatcagtaacgactacatgacccgtgggccccgccgaggcctaccgagggggaacgggggctgggaggtcgggtctcgagtttaatagaaacgngatggacaactactattaaattacttcgtagtaccttccggtaggaacggggtcccggttccaccctctaccaaggacacctacttaccaaaacactattccttatactcttacacatcgactacaatctgagagtaccgacacgaccgtccaacttaattacttggtcgcgaccgacagttcgacctaacgtcctaacaatttcgggacggggaaccgaacgggggaacccg

SEQ ID NO: 366020 - DNA, 643 bp, Homo sapiens
  misc_feature: GZ8MTXP01D8VMI.10.38.D05.1.454.CMB.2.raw
  modified_base (256)..(256): a, c, t, g, unknown or other
  modified_base (271)..(271): a, c, t, g, unknown or other
  modified_base (274)..(274): a, c, t, g, unknown or other
  modified_base (322)..(322): a, c, t, g, unknown or other
  modified_base (355)..(355): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggttttccgtgttaggctatttacaaaaggtgtccatgtgaggttcaactggtggagactggaggagctggatccagccgtgggggtccctgagactctcctggcncacgtctgtggtcancanacacgtaacactacacgcgccgcggccgccgacgcgacggagggaggngtggtggtgtgtagtagttagtagaagagacgngacactactattaattacttcgtacgtaccgtaccggtacggtaccgggtaccgtacccgtaccctacctaccgacgacgaacctaacctaacctaaacctaactacttacttacgttactactactactacgtacgtactaactacgtacgtacgtacgtacgtaccgaaccgtaaccgtaaccgtacccgtaaccttaacttacgttcgtacgacgacgtaacgttacgttacgttaccgtaactacgtaacgtacgtacggttacgggtaaccggaacggaaccg

SEQ ID NO: 366021 - DNA, 594 bp, Homo sapiens
  misc_feature: GZ8MTXP01B16M0.10.38.D05.1.454.CMB.2.raw
  modified_base (264)..(264): a, c, t, g, unknown or other
  modified_base (276)..(276): a, c, t, g, unknown or other
  modified_base (304)..(304): a, c, t, g, unknown or other
  modified_base (355)..(355): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagacgtggaggaggctggatccgagccgtggggggtccctgagactctcctgtgcagcctntgggttcagcancagtacgactacatcgacctgggccccnccaggcctccgaggggaaggggctgggagtgggtctcgagttattgaaacngatcggacactacataattacttctagacctccgtgaacggggtcccggttcaacccttctcccaaggacgaaccaccgtttacccaaactaacctacttccttgtaactccttacaactagtcgactacaaattcctgagtacgtaccgacgacgtaccggcctaccctaattagttgcgccgtacgattacgttcgacctcgctcgaacgttcgacgggggtccaagggggtaaccc

SEQ ID NO: 366022 - DNA, 578 bp, Homo sapiens
  misc_feature: GZ8MTXP01EX9ZP.10.38.D05.1.454.CMB.2.raw
  modified_base (213)..(213): a, c, t, g, unknown or other
  modified_base (394)..(394): a, c, t, g, unknown or other
  modified_base (407)..(407): a, c, t, g, unknown or other
  modified_base (478)..(478): a, c, t, g, unknown or other
  modified_base (501)..(501): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgcaggctccgagggaagggctggagtggtctcagttatgaaacngatggcactacattattatctgactccgtaggaacgggtccgttcaccctctccagacgactacttaccaaacaactattccttagtacttccttacacatcgacaacaattcgtagacgagtccgacgacacggcctacttattattgcgcacgaacatcgactacgctactaattcggngggccaggggacncccgagggtccaccgtcctaccccgagtccctaccacgacggccctagtcccgtccgtccccgtgggcccncccgtagccctccgagggacccnccgtaccgcgacgcgccacgccgggccgcgtcggccttcggcgttacggaacacgtcctcctacccactcgttcgcg

SEQ ID NO: 366023 - DNA, 505 bp, Homo sapiens
  misc_feature: GZ8MTXP01D1B0Q.10.38.D05.1.454.CMB.2.raw
  modified_base (239)..(239): a, c, t, g, unknown or other
  modified_base (447)..(447): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttataactatgtctctggtacaacaacacccaggccaggcccccagactcatcatttctgatgtcagtgatcggccctttgggatttctaatccgcttctctgcctccaagtctggcaacacggcttccctgaccatctccggctccacgctagaggacgaggctcattattactggcagctcatatacaccagggcacgtctcgtnaatattcggcggaggactggcgttgaccgtctacgtcacgccaaggcttcgtcccccg

SEQ ID NO: 366024 - DNA, 555 bp, Homo sapiens
  misc_feature: GZ8MTXP01EF2S7.10.38.D05.1.454.CMB.2.raw
  modified_base (346)..(346): a, c, t, g, unknown or other
  modified_base (399)..(399): a, c, t, g, unknown or other
  modified_base (410)..(410): a, c, t, g, unknown or other
  modified_base (425)..(425): a, c, t, g, unknown or other
  modified_base (472)..(472): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgtagcctctgggttcagcatcagtaacgactacatgacctgggccccgccaggctccgaggggaaggggctggagtgggtctcagttatgaaacngatcggcatacatattaattctgactcgtgaagggccgttcaccctctcaganacactaccaanaacatctgtatcttnacatggcactaatctagagagtccgaacgacacccggtccaaccttnttaagtttgttacggccgacggaacagttcgaccttacgtctacaaatttccggagggggcccctaagggggaacaaccccgg

SEQ ID NO: 366025 - DNA, 661 bp, Homo sapiens
  misc_feature: GZ8MTXP01C2U6L.10.38.D05.1.454.CMB.2.raw
  modified_base (367)..(367): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtgggaggaggctggatccgagccgtgggggtccctgagactctcctgtgcacgcctcgtgggttcagcatcagtaacgactacatcgacccgtgggccccgccgaggcctccggagggggaaggggcgtgggagtgggtctcgtagttatagaaacngatggacactaactattaattactttcgtacgtaccgttccgggtacgggtaaaccgggggtcccgtttacccaaccccgtttcgtacccgtaacggaacgaaccttaacccctttacccaaaactaaacttacttaccgtttacgtaaacttcctttaaccgacctaaggttacgactaaacctaattccgtagaacgtacgtacgaccgaaccacggaccctaacttaattgttcgtcgcgtcgattacgttgacctaacgctctaagttccggcggggccgaaggggtccc

SEQ ID NO: 366026 - DNA, 598 bp, Homo sapiens
  misc_feature: GZ8MTXP01EUQWO.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatcgaccgtgggccccgccgaggcctccggaagggggaagggggctgggagtgggtctcgagttatagaaacagatggacactacattaattattctgactccggtagaacggggtcccggttacaccccgtctccagaacgacctaaccttaccaaacaactattccttagtaatcttacacatcgacaaccaaattcagagagtaccgaacgacaaccgaacccacttaatttacgttggcgcgacgaacttagttcgaccttaacgctaactaacgtcggttacggggcccttaagggggaaccc

SEQ ID NO: 366027 - DNA, 537 bp, Homo sapiens
  misc_feature: GZ8MTXP01DDIOR.10.38.D05.1.454.CMB.2.raw
  modified_base (264)..(264): a, c, t, g, unknown or other
  modified_base (312)..(312): a, c, t, g, unknown or other
  modified_base (339)..(339): a, c, t, g, unknown or other
  modified_base (352)..(352): a, c, t, g, unknown or other
  modified_base (354)..(354): a, c, t, g, unknown or other
  modified_base (357)..(357): a, c, t, g, unknown or other
  modified_base (361)..(361): a, c, t, g, unknown or other
  modified_base (369)..(369): a, c, t, g, unknown or other
  modified_base (371)..(371): a, c, t, g, unknown or other
  modified_base (391)..(391): a, c, t, g, unknown or other
  modified_base (398)..(398): a, c, t, g, unknown or other
  modified_base (417)..(417): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcttggggtttttccttgttgctatttcaaaaaggtgtccatgtgaggttcaatggtggagactggaggaggctggatccagccgtggggggtccctgagactctcctgtgcagcctntggggttcagcatcagtaacactacatcgacctgggcccgccaggtcnccgagggaaggggctgggagtggttcnagttatgaaacananggnacanataatatntnatcgtgacggcggtcacccnctcaganacactacaacaacatactntatcttcacatacacacatatagagacgacgacgacgaccgaccaactaattagttgtgcgacgacacgttcgactaactactaacgtacgtacggttacgggtaaccggaacgggaacg

SEQ ID NO: 366028 - DNA, 725 bp, Homo sapiens
  misc_feature: GZ8MTXP01EWR7T.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtggggggtccctgagactctcctgtgcagcctgtgggtcagcatcagtaacgactacatcgaccgtcgggccccgccgagggcctaccggaagggggaacgggggcgtggggtaggttcggggtcttacgtaggtttaattacggaaaacgagtacgttcgggactaacgtactaattaaacttacttcgtacgtaccgttcccgggtagggaaaccggggttcccgggttacctaccccgttctacccgaaggaacgacctaaccttaacccaaaacctaactacttctttagtacttaccttacaacctaggtacgtaccctaaactaacttccgaggaacgtacggtaccgaccgaaccgacccggtaccctaaccgttaatttaacgtttcggcgttaccgacggtaaccaagttcggaacccttaaccggtcttaacccgttaaacggtttccggggttaccgggggtccccgaaagggggtaacccccgg

SEQ ID NO: 366029 - DNA, 633 bp, Homo sapiens
  misc_feature: GZ8MTXP01DA4IY.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgaggccgtggggggtccctgagactctcctgtgcagcctcgtgggtcagcatcaagtaacgactacatcgaccgtgggccccgcaggcctccggagggggaacgggggctgggaggtcgggtctcgtagtttattagaaacagactgggacactaacattaaatttacttcgtcgaaccttccggtagggaacggggtcccggttaccaccctctacaagacactaccttaacccaaacaactattccttagtactcttacaacgtatcgactaacaattcagagagtaccgacgtaccgaccggccctaacttaatttagttggtcgacggtaccgaattaagttcggaaccttaacggcttaacgtaaacgtttccgggacggggggtaacccaaggggggaaccc

SEQ ID NO: 366030 - DNA, 832 bp, Homo sapiens
  misc_feature: GZ8MTXP01CY3DL.10.38.D05.1.454.CMB.2.raw
  modified_base (215)..(215): a, c, t, g, unknown or other
  modified_base (237)..(237): a, c, t, g, unknown or other
  modified_base (292)..(292): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccgaggggagggctggagtggtctcagttatagaaacngatggcactacattattattcngactccgtaggaacggggtccgttcacgcctctcagacactacttccaaacaacntcttgactcctcacatcgacacaatctagaacgacgtcgaacgacacgacctaacccttatttagttgcgccgaacgaactaagttacgaaccgttaccgactacgtaaacgtttccgggacgggggacccgaggggacccgaccccggtagggttccccgtaaccccggtcccttaaccccccgaagtccccccgttaaccccgaaaccccgggaaacccggggtccccccttaaccgggttccccgggggttttacccccccgtttccccccccggggttcggggccccccggtaacccccgttaccggccccgttaaccccggaacgggggtaccctaccccggaaccccgttacccgggaaacggaacccggaccccgaaacccgggtacccggggcccccgggttacccccgggttcgggggttaccccttccggggttaccccggggtttaaccggggaaaccccggtaaaaccggggtttacccctttaaccccggtttaacccccgtaaaccgttttaaccgttaaccgggg

SEQ ID NO: 366031 - DNA, 622 bp, Homo sapiens
  misc_feature: GZ8MTXP01A6070.10.38.D05.1.454.CMB.2.raw
  modified_base (419)..(419): a, c, t, g, unknown or other
  modified_base (600)..(600): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctgagactctcctgtgcagcctctgggttcagcatcaagtaacgactacatcgacccgtgggccccgccaggcctccgagggggaagggctgggagtgggtctcgtagttatagaaacagatggacactacattaaattattctagacctccggtagaacggggcccggttacacccctntcccaaggacacctaccttaccaaaactaactattccttagtactacttacacctaattgacctaaacaaactcctaggaacgtacggtacccgaacgaacctaaccgggccctaaccgttaatttagttcggtcgaccggtacaaccttagttcgaaacctcgctaactaacgttcgggnggggaacccaagggggaacccg

SEQ ID NO: 366032 - DNA, 576 bp, Homo sapiens
  misc_feature: GZ8MTXP01DXBKY.10.38.D05.1.454.CMB.2.raw
  modified_base (261)..(261): a, c, t, g, unknown or other
  modified_base (302)..(302): a, c, t, g, unknown or other
  modified_base (437)..(437): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctntgggttcagcatcagtaacgactacatcgacctgggccccncaggctccgaggggaagggctggagtgggtctcgagttatagaaacagatggcactacataacttattctgactccggtagaacgggccggttcaccctcgtccagagaccacttaccaaactaacattcgtttntaactcttacacatcgcaacaatcctagacgagtaccgacgtaaccacggtacccaccttaatttattgtcgcgcgaacacgttgaaaccctgaccttaacgtaacttcggttagggggtaaccccgaaggggaacccg

SEQ ID NO: 366033 - DNA, 729 bp, Homo sapiens
  misc_feature: GZ8MTXP01AWJMR.10.38.D05.1.454.CMB.2.raw
  modified_base (465)..(465): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactcctcctgtgcagcctcgtgggttcagcatacagtaacgactacagtcgacccgtcgggccccgccgacgggcctacccggaagggggaacgggggcgtggggaggtcgggggtctacgtagtttattagaaacgagacgtggacaactaacatttaaactttactttcgtagtaccgttcccgggtacgggtaacggggtccccggttacaacccccttntaccccgaggaacgacctacccttacccaaaacctaactacttcctttagtaacttccttacaaccgtattcgactaaaccaaattccgtggaacgtacgtaccgaaccggaaccgacccgggtacccctaaccctttaagtttaacgttcgggtacggacccgaaccgggtaacccttaggtttccgaaacccgtttaacccggaccttaacgtaaacggttttccgggaccggggggtaaccgttaacggggggtaaccccg

SEQ ID NO: 366034 - DNA, 650 bp, Homo sapiens
  misc_feature: GZ8MTXP01CJ9I8.10.38.D05.1.454.CMB.2.raw
  modified_base (376)..(376): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgcaggctccgagggggaaggggctgggagtgggtctcgagttattggaaacagactggacactacataattatcngtactcgtgaacgggccggttcaccctctcccagacgactaccttccaaactaacattccttgtaacttccttacaccgatcgactaaccaaatcctggagtacgtaccggaaccgtaaccgaccgggaccctaaccctttaatttaagtttcgggtacgcccggttaaccggaccttaaaggttcggaaaccccgtttaaccggccctttaaccgtaaacgtttttccccgggttacggggggggtaacccccaaaggggggggtaacccccg

SEQ ID NO: 366035 - DNA, 657 bp, Homo sapiens
  misc_feature: GZ8MTXP01COWZI.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccccagactctcctgtgcagcctctgggttcagcatcagtaacgactacatcgaccgtcgggccccgccgacggcctaccggagggggaacgggggcgtagggtaggtcgggtctacgtaaggtttagttagaaacgagagtccggacctaactactaattaatttaaattcgtcgtaccgttccgggtagggtaaacggggtcccggttaccaccccgttctacccgagaccgacctaccttaccaaactaactacttcttagtaacttccttacaactattcggacctaactaacttcgtaggacgtacgtaccgaaccgaccgaccggtaccctaccgttattaacgtgttgaccgcgaactgttacgaccttcgctactaagttccggagggggaccctaagggggcctaaccccgg

SEQ ID NO: 366036 - DNA, 589 bp, Homo sapiens
  misc_feature: GZ8MTXP01EPXBV.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcagtaacgactacatcgaccgtcgggccccgccgaggcctccgaggggaagggggctgggagtgggtctcgagttactagaaacagatggacactacattaattattctgactccgtagaacgggtccggttcaccctctaccagacgacaccttaccaaacactattctagtactctacacagtgacaacaatctagacgacgtaccgaacgtaccgaccggtcctaacccgttaatttagttcgtgccgtacgaacttacgttcaaccttaacgcttaacgtaacgttcgacgggggtcccaaggggaacccg

SEQ ID NO: 366037 - DNA, 618 bp, Homo sapiens
  misc_feature: GZ8MTXP01DRB3Y.10.38.D05.1.454.CMB.2.raw
  modified_base (550)..(550): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtcctgagactctcctgtgcagcctcgtgggttcagcatcagtaacgactacatcgaccgtgggccccgccgaggctccgagggggaaggggctgggagtgggtctcgtagttatagaaacagatggacaactactattaaatttattcgtagaccgttccgggtagaacgggggtcccgttacacccctctacccaaggacgactaaccttacccaaactaactattccttgtaacttcttacactatcgacaacaaatctagagacgtaccgaacgtacgaccgtcccaacgttaatttaacgttggtacnccgacgtaacagttggaccctaagccttaacgtaacgtttcggagggggccccgaagggggaaccccg

SEQ ID NO: 366038 - DNA, 638 bp, Homo sapiens
  misc_feature: GZ8MTXP01BZMI6.10.38.D05.1.454.CMB.2.raw
  modified_base (176)..(176): a, c, t, g, unknown or other
  modified_base (255)..(255): a, c, t, g, unknown or other
  modified_base (267)..(267): a, c, t, g, unknown or other
  modified_base (269)..(269): a, c, t, g, unknown or other
  modified_base (271)..(271): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtggtttcgtgtaggctattacaaaggtntccatgtgaggttcaactggtggagacgtggaggaggctggatccgagccgtggggggtccctggacgctctctgtgcncgctcgtggtcngnanacagtacactacagcgccgtcggcccgcgacgcgcggaggggagggcgtgggtggtcggtctagtagttagtaagaaacgagacgtacggactaactaactaattaactttacttcgtacgtaccgttcgggtacgggtaccgggtcccgttacccacccctctacgaacggacacctaaccctacaaactaactacttacgttactacttctacacgtactacgtactaactaactacgtacgtacggtacgtaccgaccgtaaccgaccgtacctaacgttaacttacgttcgtcgacgacgtacttacgttcgttaccgtaaccgtacgtaacgtacgtcggttacgggtaaccggcggtaacg

SEQ ID NO: 366039 - DNA, 597 bp, Homo sapiens
  misc_feature: GZ8MTXP01EO54R.10.38.D05.1.454.CMB.2.raw
  modified_base (362)..(362): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggtcagcatcagtaacgactacatcgaccgtcgggccccgccgaggctaccggaggggaagggggctgggagtgggtctcgagttatagaaaccngatggacactaacattaatttattcacgtaccgttccggtagggaaacggggtcccgtttaccaccccgttctacccgaaggacaaccctaaccttaccaaaactaactattccttagtaacttccttacgactagtcactaacaatcgtagaacgtcgtaccgacgacgccggaacctaacttattacttgcgcgagcatcgactcgctacgttacgttcggcggggaacccgg

SEQ ID NO: 366040 - DNA, 661 bp, Homo sapiens
  misc_feature: GZ8MTXP01BS505.10.38.D05.1.454.CMB.2.raw
  modified_base (347)..(347): a, c, t, g, unknown or other
  modified_base (380)..(380): a, c, t, g, unknown or other
  modified_base (394)..(394): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccgaggggaaggggctggagtgggtctcagttatgaaacagatggcactacatattattctgactcgtgaacgggccgttcaccctctccagagacacttccaaacaacatcttgtatcttcacatgcaacaatctagagagtcgaccgacacgccaccttattacttgngcgcgaactatcgaactacgctactaattcggnggggccaggggacncccgtacgggtccaccggtcctaccccgacgccctaccaacccgaacgggcccctaacgttccccggttccccgttcccccgttcggggccccgtccccgttcgaccccgtacccgacgggtaaccgcccaaccccgtcccggaacgaccggaaccaccgacgggcccggccccggttcgggggcccttccgggcccgttcggggttaaacccaaccggggtaaccttaccccggtttccccaaccgtttaacccttaagttccggg

SEQ ID NO: 366041 - DNA, 691 bp, Homo sapiens
  misc_feature: GZ8MTXP01ANFM5.10.38.D05.1.454.CMB.2.raw
  modified_base (271)..(271): a, c, t, g, unknown or other
  modified_base (354)..(354): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagctctctgtgcagcctctgggttcagcancagtaacgactacatcgacctgggccccgccaggcctccgagggggaaggggctgggagtgggtctcgagttacttagaaacngatggacactacattaattattctgaccgtccggtaggaacggggtcccgttccaaccccgttctacccgaaggactacctaaccttacccaaaacctaactacttccggtttagtaaccttcttaccaaccgagttcgacctaacaaaactttccaaggggaagtacgttaacccggggaaccgtaaacccggaacccgggtcccccttaaacctttaagttttaaaccgtttgggtccgccgggtaccgaaccttagttaccgttaccggttaaacccgtccttaacgttaacggttccgggttaccgggggtaacccgttaacgggggaacccg

SEQ ID NO: 366042 - DNA, 585 bp, Homo sapiens
  misc_feature: GZ8MTXP01DMMGI.10.38.D05.1.454.CMB.2.raw
  modified_base (261)..(261): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctntgggttcagcatcagtaacgactacatgaccgtgggccccgccaggctccgaggggaaggggctgggagtgggtctcagttatgaaacagactggacactacataattattctgactccgtgaacggggtccgttcaccctctaccagacgacctacttaccaaacaactattacttgtaacttcttacactatcgactaacaactctacggagacgtaccgaacgtacaccggccctaacttaattagttggtcgcgtcgacttaagttcgaacctaacgctaacgtaagttccggttcgggggaacccgaagggggaacccg

SEQ ID NO: 366043 - DNA, 708 bp, Homo sapiens
  misc_feature: GZ8MTXP01AHOER.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcacgcctcgtgggttcagcatcagtaacgactacatcgaccgtcgggccccgccgacggcctaccggagggggaacgggggcgtgggaggtgggtctcgtagttattaggaaacagactggactacgtaactattaaattacttcgtacgtaccgttccggtacgggtaaccggggtcccggttcctaaccccgttcctaccgaacgacgtaacctaccttacccaaactaaactacgttaccttagttacttcttaccaacgtacttacgacctaaactaaacgttccgtaaggtaagtaaccggtacccgaaaccgacccgtaacccgggtaccccttaacctttaagttacgtttggtcgaccgggacctaacgttacgttcggaacccttaaccggccttaacgtaacggttccgggttacgggggtaacccgaagggggtaaccccg

SEQ ID NO: 366044 - DNA, 560 bp, Homo sapiens
  misc_feature: GZ8MTXP01AFSZX.10.38.D05.1.454.CMB.2.raw
  modified_base (304)..(304): a, c, t, g, unknown or other
  modified_base (355)..(355): a, c, t, g, unknown or other
  modified_base (438)..(438): a, c, t, g, unknown or other
  modified_base (465)..(465): a, c, t, g, unknown or other
  modified_base (539)..(539): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctcgggccccnccaggctccgagggggaaggggctgggagtgggtctcgagttatagaaacngactggcactacataattatctgacctcgtgaacgggtccgttacaccctctaccaggacacacttaccaaacaacattcgtntactcttacacaggtcacaacaagtcngagacgtaccgacgaccaccggtccaaccttaattattcgcgcgacacattgacctaacgctaacgaattcggnggggaacccaaggggaacccg

SEQ ID NO: 366045 - DNA, 539 bp, Homo sapiens
  misc_feature: GZ8MTXP01AHGX6.10.38.D05.1.454.CMB.2.raw
  modified_base (304)..(304): a, c, t, g, unknown or other
  modified_base (352)..(352): a, c, t, g, unknown or other
  modified_base (374)..(374): a, c, t, g, unknown or other
  modified_base (456)..(456): a, c, t, g, unknown or other
  modified_base (493)..(493): a, c, t, g, unknown or other
  modified_base (499)..(499): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctgggccccnccaggctccgaggggaggggctgggagtgggtctcgagttatgaaacngatggcactacataattattcngactcgtgacgggtccgttcaccctctccagacgaccacttaccaaacactatccttgtatcttacacatcgacacaattcngagacgtacgacgtacacggccaccgtaattattgtncgcgangttgactcgctcaacttcggacggggccttaaggggcccg

SEQ ID NO: 366046 - DNA, 612 bp, Homo sapiens
  misc_feature: GZ8MTXP01EPABN.10.38.D05.1.454.CMB.2.raw
  modified_base (275)..(275): a, c, t, g, unknown or other
  modified_base (365)..(365): a, c, t, g, unknown or other
  modified_base (465)..(465): a, c, t, g, unknown or other
  modified_base (480)..(480): a, c, t, g, unknown or other
  modified_base (496)..(496): a, c, t, g, unknown or other
  modified_base (538)..(538): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcancaagtaacgactacatcgaccgtcgggccccgccgaggctccgagggggaaggggcgtgggagtcgggtctcgtagttatagaaacaganggacaactacataaattattcgtgaaccgtccggtaggaacggggtcccggttaccaccccgtctaccgagacgacctacttacaaacactatccgttanactcttacacgtatnacaactagtctagacncggtaccacgaccgaccgcctaaccgttaatttattcggacnccgaacgaacttacttcggaacctaacggcctaacgttaaacgttcgggacgggggcccgaagggggaaccccg

SEQ ID NO: 366047 - DNA, 582 bp, Homo sapiens
  misc_feature: GZ8MTXP01CGRQD.10.38.D05.1.454.CMB.2.raw
  modified_base (305)..(305): a, c, t, g, unknown or other
  modified_base (357)..(357): a, c, t, g, unknown or other
tcagcatagtagtgcacgaccggtgctcgatttagtatctgatagttgggtttgggggggagaggagcccagcactggaattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtcccctgagactctcctgtgcagcctctgggttcagcatcagtaacgactacatcgacctcgggccccnccgaggcctccgaggggaaggggctgggagtgggtctcgagttatagaaacngatggcactacataattatctgactccgtagaacgggtccggttcaccctctccagacgactacttaccgaaacactattcgttatatccttacaaccatcgtacacaatctaggagcgtacgaccgacgaccggccctaccgtaattacttggtcgcgacgaacttcgttggacccttaacggcctaactaacgtttcggacgggggcccaagggggaaccccg

SEQ ID NO: 366048 - DNA, 522 bp, Homo sapiens
  misc_feature: GZ8MTXP01AQITZ.10.38.D05.1.454.CMB.2.raw
  modified_base (431)..(431): a, c, t, g, unknown or other
  modified_base (446)..(446): a, c, t, g, unknown or other
  modified_base (479)..(479): a, c, t, g, unknown or other
  modified_base (487)..(487): a, c, t, g, unknown or other
  modified_base (493)..(493): a, c, t, g, unknown or other
  modified_base (509)..(509): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctgggccccgccaggctccgagggggaaggggctggagtgggtctcgagttatagaaacagatggcactacataattattctgactcgtgaacggggtccgtcaccctctcagacgacacttaccaacaactatccttntactcttacacagtncaacaatctgagacgtcgacgacacgcctactntattgtcncgcacnttgactgctcaatcgngggccaaggggcc

SEQ ID NO: 366049 - DNA, 592 bp, Homo sapiens
  misc_feature: GZ8MTXP01BXEQL.10.38.D05.1.454.CMB.2.raw
  modified_base (272)..(272): a, c, t, g, unknown or other
  modified_base (354)..(354): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggtcagcancagtaacgactacatcgaccctgggccccgccaggcctccgaggggaaggggctgggagtgggtctcgtagttatagaaacngatggacactacattaattattctgacctccggtaggaacgggtccgttcaccctctccaagacgacacttacccaaacaactatcttagtactcttacactagtcgactaacaatccgtagacgacgttaccgaaccgaacctaacccggcctaacctaatttaacttggtcgccgtacgacagttcgaccttaacgctaacgtaacttcggttacggggccgaacgggggaacccg

SEQ ID NO: 366050 - DNA, 613 bp, Homo sapiens
  misc_feature: GZ8MTXP01EHU1R.10.38.D05.1.454.CMB.2.raw
  modified_base (305)..(305): a, c, t, g, unknown or other
  modified_base (352)..(352): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcaagtaacgactacatcgacctgggccccnccaggctccgaggggagggctgggagtgggtctcagttatagaaacngatggacactacattaattattctgactccggtagaacgggtcccggttcaccccgtctacccagacgacctaccttaccaaacactatccttagtactcctttacaacctattacgacctaacaaatttcgagaacgtacgtaccgaacgtaccgaccggtccctaaccgttaattacgttggcgcggaccgaacttagttcggaaccctaacgcttcgtaaacgtttccgggacgggggaacccgaagggggaaccccg

SEQ ID NO: 366051 - DNA, 596 bp, Homo sapiens
  misc_feature: GZ8MTXP01CZIYS.10.38.D05.1.454.CMB.2.raw
  modified_base (512)..(512): a, c, t, g, unknown or other
  modified_base (543)..(543): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttatgaaacagatggcactacattattattctgactccggtgaacgggtccggttcaccctctccagacgacacttccaaacaactatcttagtatcttacactatcacaacaatctagagagtcgacgacacggcctacccgtattagttgtgccgaacgacaagttcgaccctacgctacaatttcggacggggccaggggaccgcccgacggtccacccgtcctaccccacgccctacccacgaaccggcccacgtccggggttcccctccccgttcgcccgccctcgcctccgaggtcnccaccgtccgagaacgcacgacgccggtccngggccttcgccgtcggtaccaacggtaccctaccgttacccaacgttctaacg

SEQ ID NO: 366052 - DNA, 592 bp, Homo sapiens
  misc_feature: GZ8MTXP01CUEKW.10.38.D05.1.454.CMB.2.raw
  modified_base (307)..(307): a, c, t, g, unknown or other
  modified_base (432)..(432): a, c, t, g, unknown or other
  modified_base (470)..(470): a, c, t, g, unknown or other
  modified_base (496)..(496): a, c, t, g, unknown or other
  modified_base (508)..(508): a, c, t, g, unknown or other
  modified_base (524)..(524): a, c, t, g, unknown or other
  modified_base (529)..(529): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtggaggaggctggatccagccgtgggggtccctgagactctcctgtgcagcctcgtgggttcagcatcagtaacgactacatcgaccgtgggccccncaggcctccgagggggaacgggctgggagtgggtctcgtagttatagaaacagaatggactactaactattaacttaattccgtgtaaccgtcgggtacgaacggggtccccgttacaccccttncccaaggaacactaaccttaccaaacaactactcttanacttctacactatcacaactaatccngagtagacgacnaccggctactaattangtacncgtcgaacagttgaacctcggtactaaccgtaagtcggttacggggccttaacgggggaaccg

SEQ ID NO: 366053 - DNA, 557 bp, Homo sapiens
  misc_feature: GZ8MTXP01BHIJB.10.38.D05.1.454.CMB.2.raw
  modified_base (354)..(354): a, c, t, g, unknown or other
  modified_base (504)..(504): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctgggccccgccaggcctccgagggggaaggggctgggagtgggtctcgagttatagaaacngatggcactacataattattctgactcgtgaacgggtccgttcaccctctcagacgactacttaccaaacactattctgtactcttacacatgacacaatctgagagtcgacgacaccggccaacctaattacttggtacgcgacgaacngttcggaacctaacggctaactaacgttcgttacgggggccaagggggaaccc

SEQ ID NO: 366054 - DNA, 643 bp, Homo sapiens
  misc_feature: GZ8MTXP01E2AAZ.10.38.D05.1.454.CMB.2.raw
  modified_base (274)..(274): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcancagtaacgactacatcgaccgtcgggccccgccgacggcctccggaagggggaacgggggcgtaggggaggtcgggtctacgtagtttattagaaacgagatcggactaactactaattaaattattctacgtaccgtccggtacgggtaacggggtcccggttccaaccccgtctaccgaaggacgtaacctaacttacccaaacaaactacttacttagtacttcttacaactacggttcacctaactaacgtcgtagacgtacgtaccgaacgaccaccggaccctaacttaatttaacgttgcgcgcgacttagttccgacttaacgccttaacgtacgttcggacggggccgaaggggaacccg

SEQ ID NO: 366055 - DNA, 657 bp, Homo sapiens
  misc_feature: GZ8MTXP01BQH5Z.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctgggccccgccaggcctccgagggggaaggggcgtgggagtgggtctcgagttatagaaacagatggcactacattaatttattctagacccgttccggtagggaaacggggtccccgggtttaccaacccccttcgtacccgaaggaacgtaaccctacctttaaaccccaaaacctaaactactttccctttagtaacttcctttaccgaactacttcgaccaacctaaagtcctaggaacgtacgtacccggaacgtaccgaccggaccctaacctaattttacgttcggtcgcgaccgaacttaagttcgaaccttaacgctaacgtaagttcggacggggtaaccaagggggaaccc

SEQ ID NO: 366056 - DNA, 553 bp, Homo sapiens
  misc_feature: GZ8MTXP01EX2MX.10.38.D05.1.454.CMB.2.raw
  modified_base (173)..(173): a, c, t, g, unknown or other
  modified_base (218)..(218): a, c, t, g, unknown or other
  modified_base (264)..(264): a, c, t, g, unknown or other
  modified_base (270)..(270): a, c, t, g, unknown or other
  modified_base (352)..(352): a, c, t, g, unknown or other
  modified_base (372)..(372): a, c, t, g, unknown or other
  modified_base (384)..(384): a, c, t, g, unknown or other
  modified_base (481)..(481): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccnccaggctccagggaaggggctggagtgggtctcagttatgaaacngatggcactacatattatctgactccgtgaagggccgttcaccctnccaganacacttccaaacaacatcttgtatcttcacatgcaacaatctgagagtcgacgacacggccaaccctattatgtgcgcgacngtgactacgctacaattcgnggggccagggcnccgaggtccaccgtcctccccagccctccaacccgaacgggccccacgtccggggtccttcccccgtggccgccctgcctccgacggcgcctacccnccgagcgcacgcgttccggcccgtgggccttggcccgtggtcaacggtcctaccttacccaacttaaccgtg

SEQ ID NO: 366057 - DNA, 564 bp, Homo sapiens
  misc_feature: GZ8MTXP01ASLE4.10.38.D05.1.454.CMB.2.raw
  modified_base (402)..(402): a, c, t, g, unknown or other
  modified_base (422)..(422): a, c, t, g, unknown or other
  modified_base (426)..(426): a, c, t, g, unknown or other
  modified_base (497)..(497): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggttggatccagccgtgggggtccctgagactctcctgtgcagcctcgtgggttcagcatcagtaacgactacatgacctgggcccgcaggctccgaggggaggggctggagtgggtctcgtagttattagaaacagatcggacactacatattaattctgactccgtggacgggtccgttcaccctcnccagacgacacttaccaaanaacnttcttagtactcttacactatcggacaactaatcgtagagacgtacgaaccgactacccggcctaaccttnttaactgttcgcgcgacagttcgacttacgctacaagttcggagggggaccctaagggcgaaccccg

SEQ ID NO: 366058 - DNA, 709 bp, Homo sapiens
  misc_feature: GZ8MTXP01ECCNQ.10.38.D05.1.454.CMB.2.raw
  modified_base (564)..(564): a, c, t, g, unknown or other
  modified_base (630)..(630): a, c, t, g, unknown or other
  modified_base (687)..(687): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtcctgagactctcctgtgcacgcctcgtgggttcagcatacagtaacgactaacagtcggacccgtcgggccccgacccgagggcccgtaccggaacggggggaaacgggggtccgttagggggagggtttcgggggttacttacgtaaggtttaattaaggaaaacgaggtaacgtcgggacctaaacttaacctaagtttaaactttaacgtttccgtacggtaacccgttacccgggtacgggtaaaccgggggttccccgggttaccctaacccccgttctacccgaaggtaaccacctaacttacccaaaacgtactattcctntaactcttacatagtcactactaatcgagagtacgaccggaaccgacgaccggtaccctaacgttntttaacgttgaacgccgacgacttaagttcgttaccaagtctaactaagttccgggnggtaacccgaagggggtaaccc

SEQ ID NO: 366059 - DNA, 656 bp, Homo sapiens
  misc_feature: GZ8MTXP01CMO4H.10.38.D05.1.454.CMB.2.raw
  modified_base (353)..(353): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgaccctgggccccgccaggctccgagggggaaggggctgggagtgggtctcgagttatgaaacngactggacactacataattattctgtactccggtggaacggggtcccggttccaaccccgtctacccgaaggacgtacctaaccctttaccaaactaaactattcctttagtaacttcctttacaacctagttcgacctaaacctaaattccgtaggaaggacgtaccgaaccggtaacccaacgggcccctaaaccgttaatttaacgttcggtcgccggtacgaaccttagttccggaacctttaaccggccttaacgaaacgtttccggttacgggggccccttaaggggggtaaccccg

SEQ ID NO: 366060 - DNA, 645 bp, Homo sapiens
  misc_feature: GZ8MTXP01EZUNB.10.38.D05.1.454.CMB.2.raw
  modified_base (227)..(227): a, c, t, g, unknown or other
  modified_base (242)..(242): a, c, t, g, unknown or other
  modified_base (263)..(263): a, c, t, g, unknown or other
  modified_base (313)..(313): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgtcctgactcagcctccctccgcgtccggtctcctggacagtcagtcaccatctcctgcactggaaccngcagtgtactttgtncttatactatgtctctgtacngcaccaccagcaaacgcccctaatcctttgtttgagtcagtacgcgcctnacggactcctgacttcggttctcgtccgcctacaagtctcggaaccaaccgccggtccctcccgtgacccgttctcggtcgggcctccgaggctaggaggatggacggtcttagtaacttactacgtcgacgacggcgtactaattacgtacccgaaccggtaccccctaaagggtcgggttcgggtttcggggaccgggtacgggtaacgttaggggtccggtacccggttacggtcggggttaccgaccggtacccgaacggttcccgttacccggtccccctacgggtcctaccgttcccgttccgttcccccgttcccgttaaccccg

SEQ ID NO: 366061 - DNA, 637 bp, Homo sapiens
  misc_feature: GZ8MTXP01D3C4Y.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtcctgagactctcctgtgcacgcctcgtgggtcagcatcagtaacgactacatcgacccgtcgggccccgccgacggcctaccggagggggaacgggggcgtgggaggtcgggtctcgtagtttatagaaacagactggactactactaattaattacttctgtaccgttccggtaggaacgggtcccggttacctacccctctacccgaagacgaacctaaccttaacccaaacaactattccttagtactcttacactagtcactaactatcgagacgagtaccgaactaccgaccggtacctaaccttaattagttcggtcgcgacgaacttacgttcgaaccttaacggccttaacgtaacgttcgggacgggggaaccgaacgggggtaaccccg

SEQ ID NO: 366062 - DNA, 554 bp, Homo sapiens
  misc_feature: GZ8MTXP01AQ7AY.10.38.D05.1.454.CMB.2.raw
  modified_base (349)..(349): a, c, t, g, unknown or other
  modified_base (511)..(511): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaggggctgggagtgggtctcagttatgaaacngactggcactacataattattctgtactccgtgaacgggtccgttcacccgtctccagacgacaccttaccaaacaacctatccttgtaactcttacactatgacaacaatctagagtacgtacgacgaccgacgcccaccttaattacgttgcgcgacgangttgaacctcgctcaacgttcgagggggcccaagggggaaccc

SEQ ID NO: 366063 - DNA, 599 bp, Homo sapiens
  misc_feature: GZ8MTXP01CABKG.10.38.D05.1.454.CMB.2.raw
  modified_base (458)..(458): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcaagtaacgactacatcgaccgtcgggccccgccgaggcctccgagggggaaggggcgtgggagtgggtctcgtagttatagaaacagatggacactacataattattctgacctccggtaggaacggggtcccggttcacccctctacccaggacgacctacttacccaaacaactattccgttntacttcttacaactatcgaccaactaatcgtagaacgaggtaccgacgtaccgaccggtaccctaaccttaattagttggtcgcgacgacagttcaccgttaacgctaacaacgttcggacgggggcccaagggggaaccc

SEQ ID NO: 366064 - DNA, 595 bp, Homo sapiens
  misc_feature: GZ8MTXP01EWZFW.10.38.D05.1.454.CMB.2.raw
  modified_base (350)..(350): a, c, t, g, unknown or other
  modified_base (403)..(403): a, c, t, g, unknown or other
  modified_base (426)..(426): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctctgtgcagcctcgtgggttcagcatcagtaacgactacatcgaccgtgggccccgcaggctccgagggggagggctgggagtgggtctcgagttatagaaacngactggacactacattaattattctgactccgtgaacgggtccgtcacccttnccagacactacttacaaacactntcttgactcttcacatcgacaactaatctaggacgtagtaccgaaccgtacgacccggtccctaaacgttaatttaacgttggacgccgacgtaacaattcggaaaccctaacgggtccttaaccgtaaacgtttccggggacgggggtccccaaggggggtaaccccg

SEQ ID NO: 366065 - DNA, 600 bp, Homo sapiens
  misc_feature: GZ8MTXP01DFOPM.10.38.D05.1.454.CMB.2.raw
  modified_base (273)..(273): a, c, t, g, unknown or other
  modified_base (355)..(355): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcancaagtaacgactacatcgaccctgggccccgccaggctccgagggggaaggggctgggagtgggtctcgagttatagaaacngatggacactacataattatctgactccgtaggaacgggccgttcaccctctccagacgacacttaccaaacaacattccttgtaactcttacacattcgactaacaactctagagacgtaccgacgtaaccaccgggaccctaacccttaattaacttggtacgcgtaccgaacgttaaagttcgttaaacctaaccggtacttaactaaacgtttcggacgggggtcccaagggggtaacccc

SEQ ID NO: 366066 - DNA, 675 bp, Homo sapiens
  misc_feature: GZ8MTXP01BHPC8.10.38.D05.1.454.CMB.2.raw
  modified_base (421)..(421): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcagcctcgtgggttcagcatcaagtaacgactacatcgacccgtgggccccgccgaggcctccgagggggaagggctgggaggtgggtctcgtagtttatagaaacagatggactaactactataattattctgtacctcggtagaacgggtcccgttcaccctntccaagacgacctaccttacccaaacaacctattccttagtaactaccttacgaacctaggttacgacctaactaactccgtaggaacgtacggttaccgaaaccgtaccgtaacccgggtccctaaccgtttaaagtttcgttgggtaccggaccgaccggtaacttacggttcggttaacccttaaccggtctttaacccgaaacggttttcccgggaacggggggtaaccccttaacggggggtaaccccg

SEQ ID NO: 366067 - DNA, 559 bp, Homo sapiens
  misc_feature: GZ8MTXP01BT7BZ.10.38.D05.1.454.CMB.2.raw
  modified_base (445)..(445): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaagggggctgggagtggggtctcgagttattgaaacagatggcactacattaattattctgactccgtgaacggggtccggttcaccctctccagagacaccttccaaacaactatcttagtatcttanactagtgacacaatctgagagtcgacgccaccggcccaccgtaattacgttgtcgcgcgaacattcggacctaacggctcaagttcgttacgggggcccttaagggggaacccg

SEQ ID NO: 366068 - DNA, 803 bp, Homo sapiens
  misc_feature: GZ8MTXP01DOZN7.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggctggatccaggccgtggggggtccctgagactctcctgtgcagtcctgtgggttcagcatcaagtaacgactaacatcgacccgtgggccccgccaggcctaccgagggggaacgggggcgtgggaggtcgggtctcgtagttattagaaacagactggacactacattaactttatttcgtacggtaccgttccgggtacggtaaaccgggggtcccgttttaccaacccccgtttctacccgaacggtacgaaccctacctttaacccaaaactaacctactttcgtttacgttaacttaccctttaccaaacccgttagtaccgtacctaaaaccctaaaagtttccgttaaaccgggaaggtaaccgggtttaaacccggaacccgggtaaaccgaaccccggggtaaccccttaaaccccggtttttaattttaaacccggtttgggttaaccgggaccggtaacccggtaaccgttaaacgttccgggttaaaccccttaaccgggtaaccctttaacgttaaacggttttccccgggggaccggggggtccccgttaaaacgggggggtaacccccg

SEQ ID NO: 366069 - DNA, 593 bp, Homo sapiens
  misc_feature: GZ8MTXP01DQI1L.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagcctcgtgggttcagcatcaagtaacgactacatcgaccgtcgggccccgccaggcctccgagggggaagggctgggagtgggtctcgtagttatagaaacagatggacactacataaattattctgtacgtccggtagaacgggtccgtcaccctctacccagacgactaccttacccaaactaactattccttagtactcttacactaatcgacctaacaaactctgaagacggtaccaacgtaccaaccggcccctaaacgttaatttaattggtcgcgacacttagttgaacctaactctaactaatcgttcgggccgttaaggggaaccc

SEQ ID NO: 366070 - DNA, 585 bp, Homo sapiens
  misc_feature: GZ8MTXP01B34FW.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctggggccccgcaggcctccgaggggaagggggctgggagtgggtctcgtagttattagaaacaggatggacactacattaattattctgacctccgtgaacggggtccgtcacccctctcagagaccaccttccaaacaacctattccttagtactcttacactattcgcaacaatccgtgaacgacgtaccgaacgtaccgaccggccctaaccgttaatttcttggtcgccgcgacagttcgactaacgctaactaacgttcggcgggggaacccttaagggggaacccg

SEQ ID NO: 366071 - DNA, 553 bp, Homo sapiens
  misc_feature: GZ8MTXP01CIURH.10.38.D05.1.454.CMB.2.raw
  modified_base (274)..(274): a, c, t, g, unknown or other
  modified_base (354)..(354): a, c, t, g, unknown or other
  modified_base (379)..(379): a, c, t, g, unknown or other
  modified_base (435)..(435): a, c, t, g, unknown or other
  modified_base (443)..(443): a, c, t, g, unknown or other
  modified_base (463)..(463): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcancagtaacgactacatgacctgggccccgcaggctccgagggggaaggggctgggagtggggtctcgagttattagaaacngaatcggacactacataattattcngactcgtagaacgggccgttcaccctctcagacgacacttacaaacacatccgttntactcttnacgatgacaacaatctgagngtacgaacgacaccggaccaccttaattagttgtcgcgtacgacagttcgacttaacgctcaatttcggaggggtcccgaagggaacccg

SEQ ID NO: 366072 - DNA, 715 bp, Homo sapiens
  misc_feature: GZ8MTXP01AKZ61.10.38.D05.1.454.CMB.2.raw
  modified_base (281)..(281): a, c, t, g, unknown or other
  modified_base (643)..(643): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgttgggttttccttgttgctatttcaaaaggtgtccactgtgaggttcaactggtggagacgtgggaggaggctggatccgagccgtgggggtccctgacgactctcctgtgcacgcctcgtgggttcagcanacagtaacgactacatcgaccgtcggcccgccgaggccgtaccggaagggggaacggggcgtggggtaggtcgggttctacgtaagtttagtagaaacgagtacgtcggactaactaactatttaaactttacttcgtacgtaccgttaccgggtacgggtaaccggggtcccggttaccctaccccgttcaccgaaagtaacgaacccttaacccttaacccaaaaccgtaactactttaccgttacgttaaactttcccgttaccaacctagttacaacctaaactaacgttcgaacggaacgtaccgtaaccggaaccgtaccgaacccggtcccttaacgttaatttacgttcggtcncggaaccattacgttccgaccgtaacgcttaacgaacggtttccggacggggaaccgaacggggtaaccccg

SEQ ID NO: 366073 - DNA, 614 bp, Homo sapiens
  misc_feature: GZ8MTXP01CFYDU.10.38.D05.1.454.CMB.2.raw
  modified_base (220)..(220): a, c, t, g, unknown or other
  modified_base (292)..(292): a, c, t, g, unknown or other
  modified_base (407)..(407): a, c, t, g, unknown or other
  modified_base (518)..(518): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctggagtgggtctcagttatgaaacngatggcactacatattattctgactcgtgaacgggccgttcaccctctccagacacacttaccaaacaactnttcttagtattaccttaaacatcgacaactaatctagagacgtcgacgacgacggcctacttattattgtcgcgacgaacatgactacgctacaagttcgcggggacacggggcnccgtacggtccacccgtcctccccgacgccctacccgaaccgacggcccctagttcccgggttcccttcccccggtcggccccgtccccgtcgaccccgtcccgacggacnccctacccgtccgagacgtccaacgcggcccggcccgtgggccttcggccttcggtaaccgaacggtcccttacgtccccataaccgttgtccggg

SEQ ID NO: 366074 - DNA, 650 bp, Homo sapiens
  misc_feature: GZ8MTXP01B9IHN.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctcgtgggttcagcatcaagtaacgactacatcgaccctcgggccccgcgacggctccggagggggaacggggcgtgggaggtgggtctcgagtttataggaaacagatcgggacaactaacattaaattacttctagtaccgtccgtagggaacgggtcccggttaccaccctctacccaggaacacctaaccttacccaaataacctattccttagtactcttacgaactactcgtacaaccaaagtcctagaacgtacgtaccgaacgtaccgacccggtacctaccttaaattacgtttggcgttcggacctaacgacgtttgaacccgtaacgccttaacgtaaacgtttccgggacggggaacccgttaacgggggtaacccc

SEQ ID NO: 366075 - DNA, 608 bp, Homo sapiens
  misc_feature: GZ8MTXP01DN7XF.10.38.D05.1.454.CMB.2.raw
  modified_base (436)..(436): a, c, t, g, unknown or other
  modified_base (555)..(555): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcacgcctcgtgggttcagcatcaagtaacgactaacatcgacccgtcgggccccgaccgacgggcctccggagggggaagggggctggggaggtcggggtctcgtagtttatagaaacagactggacaactacattaattacttcgtagtacctccggtaggaacgggtccggttacaccctntccgagacgactaccttaccaaactactattcttagtaactcttacacctagttacgacaaactaatccgtagaagtacgtacgaccgaccacggccacttaattattgtcgcgacganagttcgacctaacgctaacgtaagtcgggttacggggcccaaggggtaacccg

SEQ ID NO: 366076 - DNA, 629 bp, Homo sapiens
  misc_feature: GZ8MTXP01D4K1F.10.38.D05.1.454.CMB.2.raw
  modified_base (502)..(502): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaactggtggagacgtggaggaggctggatccgagccgtggggggtccctgacgactctcctgtgcacgcctcgtgggtcagcatcagtaacgactacatcgaccgtcgggccccgccgaggcctaccggagggggaacgggggcgtggggaggtcgggtctacgtagtttattagaaacgagactacggactaactactattaaactttacttcgtgtaaccgttccgggtaggtaaccggggtccccggttaccacccctctacccgaaggacacctaaccttacccaaaactactattcttanacttcttacacattcgacactaagtcctagagacgtacgaactaccgcgtacctactaattcttaggtcgcggactacagttcgaactcggctaacgtaagttcggacgggccgaaggggaaccccg

SEQ ID NO: 366077 - DNA, 580 bp, Homo sapiens
  misc_feature: GZ8MTXP01CSBOT.10.38.D05.1.454.CMB.2.raw
  modified_base (239)..(239): a, c, t, g, unknown or other
  modified_base (326)..(326): a, c, t, g, unknown or other
  modified_base (340)..(340): a, c, t, g, unknown or other
  modified_base (364)..(364): a, c, t, g, unknown or other
  modified_base (427)..(427): a, c, t, g, unknown or other
  modified_base (492)..(492): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttaataactatgtctcctgtaccagcaccaccaggacaaacgcccccaaattcctttgttttgaggtcagtaacgcgccctgaggngtcctgatcggttntctcgcctcagtctaggtaaaccncgcctcctgacccgtctcgtgggcctcgagctggaggatggagctgtattactatgcagcgtntactattccacgccccaagtgggttcggttgggccggtcgggtactaagggtcgtaacccgtcgnggggtcacggtaccccgaaggttcccgttcgccccccgttggacctaaccgttccgttaccgttcccctaaccccgttcctaaccccg

SEQ ID NO: 366078 - DNA, 589 bp, Homo sapiens
  misc_feature: GZ8MTXP01B854N.10.38.D05.1.454.CMB.2.raw
  modified_base (275)..(275): a, c, t, g, unknown or other
  modified_base (470)..(470): a, c, t, g, unknown or other
  modified_base (476)..(476): a, c, t, g, unknown or other
  modified_base (481)..(481): a, c, t, g, unknown or other
  modified_base (522)..(522): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcancaagtaacgactacatcgaccgtcgggccccgccagggcctccgagggggaagggggctgggaggtgggtctcgtagttattagaaacagactggacactacattaattattctgacctccggtagaacggggtcccgttcaccccgtctcagacgacaccttacaaacactatctagtatctactacatgacanaattcngacgngtacgacgactaccggccaacttaattacttgtagcggacncttaagttcgaacgtaaccggccttaacgtaacgtttccggacgggggccgttaagggggtaacccg

SEQ ID NO: 366079 - DNA, 735 bp, Homo sapiens
  misc_feature: GZ8MTXP01CWTN0.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtgggaggaggctggatccgaggccgtgggggtccctgagactctcctgtgcacgcctcgtgggttcagcatcaagtaacgactacatcgacccgtgggccccgccgaggcctccggagggggaagggggcgtgggaggtgggtctcgtagttatagaaacagatggactacgtaacattaaatttacttcgttacgtaccgttcccgggtagggtaaaccgggggtccccggtttaccacccccgttcctaccgaacgaacgaacctaaccttacccaaaactaacctattccgtttattacttcttacaacctattacgacctaactaaacttcgtacggaacgtacggtacccggaaccgtaaacccgaccgggtacccctaaacccgttaagttttaacgttcgggttaccggaccggaacggtaaccttaacgttacgggttaacccgttaacccgggtacctaacgttaaaacggtttcccggggacgggggtaacccggaacgggggtaacccccggg

SEQ ID NO: 366080 - DNA, 624 bp, Homo sapiens
  misc_feature: GZ8MTXP01B6GCG.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtcgggccccgccgaggcctccgagggggaaggggctgggaggtgggtctcgtagttattagaaacagacgtggacacgtacattaattattctgtactccggtagaacgggtccgtcaccctctcaggacacctacttaccaaactactattcttagtacttcttacaacctatacgaccctaactaaacttccgtaggaacgtaggtacccgaacgtaaccgaccggtcccctaacttaatttagttcggtacgccgtacgaacttacgttcgaccttaacgccttaacgtaacgttcggacgggggaacccttaacggggaacccg

SEQ ID NO: 366081 - DNA, 666 bp, Homo sapiens
  misc_feature: GZ8MTXP01AHHRV.10.38.D05.1.454.CMB.2.raw
  modified_base (363)..(363): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccgagccgtgggggtccctgagactctcctgtgcacgcctcgtgggttcagcatcaacgtaacgactacatcgacccgtggccccgcaggcctccgagggggaagggcgtggaggtgggtctcgtagttatagaaacngactggacactaactattaaattacttctcgaccgtccgtgggaacgggtccggttacccacccctctccaagacgaacctaccttaccaaactaactacttcttagtacttcttacaacacgtcgacaactaaactccgtagaacgacggttaccgaaaccgtaccgaacccgggtaccctaacccgtttaaagtttaacttttcgggcgaccggtaccggtaacttacgttcggaacccttaaccggaccttaacgtaacggttccgggttacgggggtaacccgaacggggtaaccccgg

SEQ ID NO: 366082 - DNA, 564 bp, Homo sapiens
  misc_feature: GZ8MTXP01BJ0G7.10.38.D05.1.454.CMB.2.raw
  modified_base (220)..(220): a, c, t, g, unknown or other
  modified_base (266)..(266): a, c, t, g, unknown or other
  modified_base (347)..(347): a, c, t, g, unknown or other
  modified_base (355)..(355): a, c, t, g, unknown or other
  modified_base (416)..(416): a, c, t, g, unknown or other
  modified_base (526)..(526): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccaggggaaggggctggagtgggtctcagttattgaaacngatggcactacatattattctgactccgtgagggccgttcaccctntccagagacacttccaacaacatcttgtatcttcacatgcaacatctgagagtcgacgacacggccacccttattatgtcncgacgacntgactacgctcaattcgtcgggccagggacgcccgaggtccaccggtcctccccacgcccnccaaccgaacgggccccagttccggggtcccttcccccgtcgcccgtcccctgccctccgacggcgccaccctccgaagcgcaccgcggccggccctgggccgcgcccgngggtcaacgggtcctaccgttcccctaacgttctaacg

SEQ ID NO: 366083 - DNA, 534 bp, Homo sapiens
  misc_feature: GZ8MTXP01C0OUT.10.38.D05.1.454.CMB.2.raw
  modified_base (366)..(366): a, c, t, g, unknown or other
  modified_base (374)..(374): a, c, t, g, unknown or other
  modified_base (406)..(406): a, c, t, g, unknown or other
  modified_base (411)..(411): a, c, t, g, unknown or other
  modified_base (424)..(424): a, c, t, g, unknown or other
  modified_base (429)..(429): a, c, t, g, unknown or other
  modified_base (454)..(454): a, c, t, g, unknown or other
  modified_base (494)..(494): a, c, t, g, unknown or other
  modified_base (499)..(499): a, c, t, g, unknown or other
  modified_base (513)..(513): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatctcaaaaggtgtccactgtgaggttcaactggtggagactggaggaggctggatccagccgtgggggtccctgagactctcctgtgcagcctctgggtcagcatcagtaacgactacatcgaccgtgggccccgccaggcctccggaagggggaaggggctgggagttgggtctcagttatgaaacagatggcactanaattattnttctgactcgtgaacgggtccgttcaccctcncaganacactacaacacntcttnatcttacacggtatgactacaatcngagtacgacgacgacaccggccaacttattagttcgcgcncgacnttcgaactacgctnaacgttcgcggggccgaaggg

SEQ ID NO: 366084 - DNA, 651 bp, Homo sapiens
  misc_feature: GZ8MTXP01CRZAV.10.38.D05.1.454.CMB.2.raw
  modified_base (281)..(281): a, c, t, g, unknown or other
  modified_base (602)..(602): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagactggaggaggctggactccgaggccggtcgggggtcctgagactctcctgtgcacgcctcgtgggttcagcancaagtaacgactacagtcgaccgtcgggccccgcgacggccgtccggagggggaacgggggcgtgggaggttggggtctacgtagtttaagttagaaacagtagtacggactactaactaagttaaactttattcgtacgtacccgttaccgggtagggaaaccggggtcccggttacccaccccttctaccgaaaggacgtaacctaacccttaacccaaaactaaacctattaccgttagtaacttcttacacatcgaactaaccatctgaacgtcgtaccgacaccgaccgcctactaattaagttgcggcgaccganacgttgacctcgcctaagtaacgttcggacggggccttaacggggcccg

SEQ ID NO: 366085 - DNA, 824 bp, Homo sapiens
  misc_feature: GZ8MTXP01CNBXG.10.38.D05.1.454.CMB.2.raw
  modified_base (230)..(230): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctcctgcactggaaccngcagtgtactttgtgacttaataactatcgtctcgtggtaccagccaacccacccgaaggaccaaacgaccccctaaacttcctttagttttgacggtcaacggtaacgccggtcccctacgagggtacgtcccgtagtacgttcggttctcctccggtccctacgtaagtcctacggaacctaaccgccggtccctacccgtcggtaccccgtccgtcggtcggggacccttacccggagggtaccgtagggaacgggtagtacggggtaacggtccttaaggtaaacctttaccgttacgtcggtaccgtaacgggaccgtacttaaacgtttaccgttacccggaaaccccggtaacccccggtaaaacgggttgggggttttaccggggttttacgggggacccgggggtaaccgggggtaaacggtttaaaccgggggtcccggtaacccgggttcccggggttacgggttaacccgaacccgggtacccgggttaaacccgggttcccgttacccccggtcccccccggttgggtaacccctaaccccgttccgttccccggttccccccgttcccccttaacccccg

SEQ ID NO: 366086 - DNA, 612 bp, Homo sapiens
  misc_feature: GZ8MTXP01BJV8K.10.38.D05.1.454.CMB.2.raw
  modified_base (304)..(304): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagacgtggaggaggctggatccgagccgtgggggtccctgagactctcctgtgcagcctcgtgggtcagcatcagtaacgactacatcgaccgtcgggccccnccgaggcctaccgagggggaaggggctgggagtgggtctcgagttatagaaacagactggacactacattaattattctgtactccggtaggaacgggtcccggttaccaccctctaccgagacgacctacttaccaaactactattcttagtacttcttacactatcgacactagtcctagagacgtacccggactaccgaccgcctaaccgttaatttagttcgtacgccggtacgaacttagttcgaacccgtcggtacctaacggtaactttccggggaccgggggtaacccgaagggggcccc

SEQ ID NO: 366087 - DNA, 665 bp, Homo sapiens
  misc_feature: GZ8MTXP01AUE6A.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcgacccgtgggccccgccgaggcctccggaagggggaaggggctgggaggtgggtctcgagttatagaaacagactggacaactacattaatttaactttcgtacgtaaccgttacccgggtacggaaacgggggtccccggttacctacccccttctacccgaaggtaacgaaccctaaccctttacccaaaactaactactttaccgttagtaacttcctttacaactagttcgacctaacgtaattccgtaggaacgaggtacccgaaccggtaaccgacccgggaccctaaccgttaatttacgttggtacgcgacgaacttagttcgactaacgctaacgaagtttccggagggggcccaaggggaacccg

SEQ ID NO: 366088 - DNA, 706 bp, Homo sapiens
  misc_feature: GZ8MTXP01B19RW.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctgtgggttcagcatcaagtaacgactacatcgaccgtcgggccccgccgaggcctaccgagggggaaggggcgtgggagtcggggtctcgtaagtttagttagaaacaggtactcggactactactaattaatttatctaggtaccgtccggtaggaaccggggtcccggttaccaacccccttctcccgaaggaacacctaccttaacccaaaactaacctatttcttacgtaattcctttacgaaccctagttcgaaccaactaaacttccgaaggacggacgttacccggaaaccgaacccgtaacccggtccctaaacctttaagtttaacgtttcgggacgcccgtaaccggaaccagtttccggaaaacccttcggtaccccttaagtaaaccgggtttccggaaccgggggggtccccttaaagggggaacccccgg

SEQ ID NO: 366089 - DNA, 634 bp, Homo sapiens
  misc_feature: GZ8MTXP01AJPHH.10.38.D05.1.454.CMB.2.raw
  modified_base (277)..(277): a, c, t, g, unknown or other
  modified_base (468)..(468): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcagcctcgtgggttcagcancaagtaacgactacagtcgaccgtcgggccccgcgacggcctccggagggggaacggggctgggaggtgggtctacgtagttatagaaacagactggacactacattaattacttcgtagtaccgtccggtaggtaacggggtcccgttaccaccctctaccaaggacgaacctaccttaccaaacaactnttccttagtactcttacacattcgactaacaattccgtaggaacgtacgtccggaaaccgtaccgacccggtacctaaccgttaatttagttcggacgccgtacgaacagttcgacctaaccgctaacgtaacgtcgggttacgggggccttaagggggaaccccg

SEQ ID NO: 366090 - DNA, 564 bp, Homo sapiens
  misc_feature: GZ8MTXP01EP6XS.10.38.D05.1.454.CMB.2.raw
  modified_base (225)..(225): a, c, t, g, unknown or other
  modified_base (240)..(240): a, c, t, g, unknown or other
  modified_base (395)..(395): a, c, t, g, unknown or other
  modified_base (437)..(437): a, c, t, g, unknown or other
  modified_base (497)..(497): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgtactttgtncttaataactatgtctcgtggtaccagccaccaccagacaaacgccccctaaattcctttgttttgacgtcagtaacgcgccctgtagggtttctagtcgcttcgtctcgcccctacagtctggacaaaccgcgtcctcctagactactcgtcgnggtacctccgagctagacgacgaggtactagtaaattgtacngacatctagattgtagtagtgtcgtctcgttacgttagtagggttcggacggacggaacnggttctcgaccgtacgtaacgcgcgaccgtaagtccgtcccgcccgtcgttactccgttccgtcccg

SEQ ID NO: 366091 - DNA, 640 bp, Homo sapiens
  misc_feature: GZ8MTXP01C95L1.10.38.D05.1.454.CMB.2.raw
  modified_base (279)..(279): a, c, t, g, unknown or other
  modified_base (310)..(310): a, c, t, g, unknown or other
  modified_base (361)..(361): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtggaggaggctggatccgagccgtgggggtccctgagactctcctgtgcacgtcctcgtgggtcagcancaagtaacgactacatcgaccgtcggccccncaggctaccgagggggaagggcgtggagtgggtctcgtagttatagaaacngactggactactactattaaatttattcgtagtacccgttaccgggtggaaaccggggtccgttaccacccgtctacccgaagtacgaacctaccttaacccaaactaaactacttcttataactccttacaactatacgacctaactaatcgtagacgacgtaccgaaccgaccacccggtacctacctttaattagttcggtcgacgtcgaccgttattcggttaacctcgtacctaacgtaacgttcgggttacggggccccgaaggggaaccccg

SEQ ID NO: 366092 - DNA, 610 bp, Homo sapiens
  misc_feature: GZ8MTXP01CQUU7.10.38.D05.1.454.CMB.2.raw
  modified_base (360)..(360): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctgagactctcctgtgcagcctcgtgggttcagcatcagtaacgactacatcgaccgtcgggccccgccaggcctccgagggggaaggggctgggagtgggtctcgagttattagaaacngactggcacgtacattaatttattctgtacctccggtagaacggggtcccgttccaccccttctaccgagacgacctaccttaccaaactactattcttagtactcttacaccatgacaacaatctagagacgtccgaacgtaccgaccggccctaaccttaattacgttggtcgcgaccggaattacgttcggaccctaacggtcctaacgtaacgtttccgggacgggggccccaagggggtaacccg

SEQ ID NO: 366093 - DNA, 637 bp, Homo sapiens
  misc_feature: GZ8MTXP01DU1I6.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtccctgagactctcctgtgcagcctcgtgggtcagcatcagtaacgactacatcgacccgtgggccccgccaggcctccgagggggaaggggctgggagtgggtctcgagttatagaaacagatggacactacattaaatttattcgtacgtaccgttcccgggtagggaacggggtcccggtttaccaaccccttctacccgaagtacgaacctaccttacccaaactaacctattaccttgtaactcttacactatcgacaacaatctagagacgtaccgacgaccaccggtccctaaccttaatttacgttggtcgaccgaccggtaacttacgttcggaaccttaaccgtcttaaccgtaagtttccggacgggggtaaccccgaagggggaaccccg

SEQ ID NO: 366094 - DNA, 634 bp, Homo sapiens
  misc_feature: GZ8MTXP01A3RO7.10.38.D05.1.454.CMB.2.raw
  modified_base (175)..(175): a, c, t, g, unknown or other
  modified_base (250)..(250): a, c, t, g, unknown or other
  modified_base (396)..(396): a, c, t, g, unknown or other
  modified_base (425)..(425): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtggttttctgtagctattcaaaaggtntccatgtgaggttcaactggtggagactggaggaggctggatccagccgtggggggtccctgagactctcctgtncagcctctgggttcagcatcagtaacgactacatgaccgtggcccgccaggctacgagggaagggctgggagtgggtctcgtaggttattacggaaacagaattcggactaactacattaaactttattcctaggacctttccggngtaaacggggtcccggtttacaccccttntacccgaagaacgacctaacctttcccaaaacctaaacctaggtacccttttagttacttacttactactacgtacgtactaacctaactacgtacgacgacgtacgaccgtaccgtaccgtacctaaccttaacttagttgtcgcgacgacgacgttcgttactaacgtacgtaacgtacgtacggttacggtaacggaacggtaacg

SEQ ID NO: 366095 - DNA, 733 bp, Homo sapiens
  misc_feature: GZ8MTXP01EQNRB.10.38.D05.1.454.CMB.2.raw
tcagcatagtagtgcacgaccggtgctcgatttagtatctgatagttgggtttgggctgtgaggttcaactggtggagactggaggaggctggatccagccgtggggggtccctgagactctcctgtgcagcctctgggttcagcatcagtaacgactacatgacctgggccccgccaggctccgaggggaaggggctggagtgggtctcagttatagaaacagatggcactacatattatctgactcgtgaacgggtccgttcaccctctccagacgacacttaccaaacaactatcttgtactcttcactatcgcaacaatcgtagaagacgtccgaacgacgaccgcctaacccttattagttgtgaccgacgacaatcgaacctacgctacgtaacgttcggtcgggggaccctaggggacctccccgaagggttccccaacccggtttcccctacccccgacgtaccccccgaaccgaaccccggaacccgggacccttacccggttccccgggtttcccccccgttcccggtcccggaccccgtccccgttcccgacccgtaccggaacgggccctaccccgtaccccggtacggaacggtaacccgccgttaacccggccggggttccccgggtcccgggtacgggttcccgttcccggcccggttaaggaaacccggtaaccggttaaccctttaccccgttacccgttaacctttaaccgtcgg

SEQ ID NO: 366096 - DNA, 635 bp, Homo sapiens
  misc_feature: GZ8MTXP01BDE2I.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgaccctgggccccgccgaggcctccgagggggaaggggcgtgggagtgggtctcgtagttatagaaacagatggcactacataattattctgactccgtaggaacgggtcccggttcacccctctccaaggacgacacctttacccaaacaaactattccttagtacttcctttacacgtatcgacaacaattcgtagacggagtaccggaacgaacccgaccgggtaccctaaccttaagtttactttcgggtcgccggaccgtaacttacgttcggaacccttaacggccttaaccctaaaaggtttcccgggacggggggaaccccttaaggggggaaccccg

SEQ ID NO: 366097 - DNA, 565 bp, Homo sapiens
  misc_feature: GZ8MTXP01DA3TL.10.38.D05.1.454.CMB.2.raw
  modified_base (304)..(304): a, c, t, g, unknown or other
  modified_base (513)..(513): a, c, t, g, unknown or other
  modified_base (556)..(556): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccagccgtggggggtccctgagactctcctgtgcagcctcgtgggttcagcatcagtaacgactacatgacctgggccccncaggctccgagggggaaggggctgggagtgggtctcgtagttatagaaacagatggacactacataattattctgactcgtagaacgggtccgttcaccctctcagacgacaccttacccaaataacattcttagtaacttccttacaacctatcgactaaaccaatctggacacggtaccgacgaccacggccaacttaattattggngccgtgacagttcgaacctaacgctcaagtcgttaggggcccnggggaaccc

SEQ ID NO: 366098 - DNA, 553 bp, Homo sapiens
  misc_feature: GZ8MTXP01BOFME.10.38.D05.1.454.CMB.2.raw
  modified_base (303)..(303): a, c, t, g, unknown or other
  modified_base (356)..(356): a, c, t, g, unknown or other
  modified_base (454)..(454): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatgacctgggccccncaggctccgaggggaagggctgggagtgggtatcgagtttatagaaacagtanggacaactacattaattatctgacctcgtagagggccgttcaccctctacagagactactacaaacactatctgtatcttacacatcgacaacatccngacgagtccgaacgccaccgcctactaattattgtcgcgacaacagttcgaaccctaacgacctcgtaaacgtcgttacgggggcccaaggggaacccg

SEQ ID NO: 366099 - DNA, 647 bp, Homo sapiens
  misc_feature: GZ8MTXP01B9VG2.10.38.D05.1.454.CMB.2.raw
  modified_base (450)..(450): a, c, t, g, unknown or other
  modified_base (489)..(489): a, c, t, g, unknown or other
  modified_base (499)..(499): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacagtcgaccgtcgggccccgccgacgggcctccggaagggggaacgggggcgtgggaggtgggtctacgtagtttataggaaacagacgtggactaactactattaaatttacttcgtgtaccgttcccggtagggaacgggtccccgggttaccaaccccgttntacccgaagtcgaaccctaaccttacccaaaactaaccntttccgttanacttcttacacatcgacaactaatctaggaacgtcgtacgacctaccgaccggtccctaaccgttaatttacgttcggcgccggacgacttaagttcgaaccctaacgcttaacaacggtttcggcggggaaccgaacgggggaaccc

SEQ ID NO: 366100 - DNA, 604 bp, Homo sapiens
  misc_feature: GZ8MTXP01ECUHL.10.38.D05.1.454.CMB.2.raw
  modified_base (218)..(218): a, c, t, g, unknown or other
  modified_base (265)..(265): a, c, t, g, unknown or other
  modified_base (272)..(272): a, c, t, g, unknown or other
  modified_base (352)..(352): a, c, t, g, unknown or other
  modified_base (361)..(361): a, c, t, g, unknown or other
  modified_base (394)..(394): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgagggaaggggctggagtgggtctcagttatgaaacngatggcactacatattatctgactccgtgaacgggccgttcaccctntccaganacacttccaaacaacatcttagtatcttcacatcgacaacaatctagagagtcgacgacacggcctacccttattattgngcgcgaacntgaacctacgctacaattcgtggggccagggcnccgaggtccacccgtctccccgagcccctaccgaaccgaacgggcccctaacgttcccgggggttcccctttccccccggtcgggccccgtccccgttcggcccttacccgaaagggccgtcccaaccctccggagaacgccacgacggttcccggccgtcgggcttcggccctgggtacaacggtcctaccttccctaacgttctaacg

SEQ ID NO: 366101 - DNA, 677 bp, Homo sapiens
  misc_feature: GZ8MTXP01CU1XU.10.38.D05.1.454.CMB.2.raw
  modified_base (396)..(396): a, c, t, g, unknown or other
  modified_base (636)..(636): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggcgtggatccgaggccggtcggggggtccctggacgactctccgtgtcgcacgtcctcgtgggttcagcatcaagtaacgactacagtcgaccgtcgggccccgccgacggccgtccggaaggggggaacggggcgtagggtaggtcgggttactacgtaagtttagtaacgaaacgngtaacgtcgggactacgtaacctattaaactttacttcgtagtaccgttcgggtaggaaccgggtcccgttaccacccctctacgacggtaacacctaacctaacccaaataacctattccgttatacttctacactatcgactaatactcgtagaacggtacgaccgaaccgaccgacccgtacctaaccttaattacgttcgtagccgtaacgtacttaagttcgaaccgtaaccgtnttaaccgagttcgggacggggaaccgttaaggggaaccccg

SEQ ID NO: 366102 - DNA, 614 bp, Homo sapiens
  misc_feature: GZ8MTXP01BQUOE.10.38.D05.1.454.CMB.2.raw
  modified_base (273)..(273): a, c, t, g, unknown or other
  modified_base (470)..(470): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcancagtaacgactacatcgaccgtcgggccccgccgagggcctaccggagggggaagggggctgggagtggggtctcgagttattagaaacagactggacactacattaattattcgtgaccgtccgtaggaacgggtccggttccaccctctccagacgactaccttaccaaacactattcttagtactcttacaacntcgcaactaatcgtagagtacggtaccgaacgaccgaccggtccctaaccgttaatttaacgttcggtacgccgacgtaacagttcggaacctaaccgcttaacgaaacgttcgggttacggggtaaccgaacggggtaacccg

SEQ ID NO: 366103 - DNA, 680 bp, Homo sapiens
  misc_feature: GZ8MTXP01CUWGZ.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggtcagcatcaagtaacgactacagtcgacccgtcgggccccgccgacgggtcctacgggaagggggacgggtcggtaggggtacgggttcgggttctacgttaagtttagtaaacgaaacgagtacgtacggactaactaactattaacttacttcgtacgtaccgtcggtagggaccgggtcccgtacctaccctctacgaacgacgtacctacctaaccaaactacttacttacgttactacttctacactacggtcaacctaatacgttcgaggacgtaccggtaccgaacccgtaccggacccgtaacccttacgttaattacggttcggtaccgcgtaccgtaacttacgttcgttacccggtcacttaacgtacggttcggggacgggtaaccggaacgggtaaccccg

SEQ ID NO: 366104 - DNA, 707 bp, Homo sapiens
  misc_feature: GZ8MTXP01DKDG2.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagcctcgtgggttcagcatcaagtaacgactacagtcgacccgtcgggccccgccgaagggcctaccggaagggggaaacgggggcgtggggtaggtgggggtcctacgtagtttaattagaaaacgagacgttggactaactaactaatttaaatttaattcgtacggtaaccgttccccgggtagggaaaccggggtcccgggtttaccaacccccgttcacccgaaggaacgacctaaccttacccaaaactaactacttccttagtaaacttcctttacaaccgattcgacctaaactaacgttctaggaagtacggtaccgaaccgtaacgaacccgggtaccctaaccttaattagtttcggtacgccgaacgtaaccttagttcggaaacccttaacgcttaacgtaacgtttcgggacgggggtcccgaagggggaaccccg

SEQ ID NO: 366105 - DNA, 604 bp, Homo sapiens
  misc_feature: GZ8MTXP01B57Z1.10.38.D05.1.454.CMB.2.raw
  modified_base (356)..(356): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctgtgggtcagcatcaagtaacgactacatcgaccgtgggccccgccgaggcctcgagggggaaggggctgggagtgggtctcgtagttatgaaacngatggacactacattaattattctagactccggtaggaacggggtccgttcaccctctccagacgacctacttacccaaactaactattccttgtaattccttacacctaggtcgactaaccaattctaggaacgacgtacgaccgtaaccgaccggtccctaacttaattattcggacgccgacgtacacgttcgaacctaacgctaactaagttcgggttacgggggccccgaagggggaaccccg

SEQ ID NO: 366106 - DNA, 645 bp, Homo sapiens
  misc_feature: GZ8MTXP01DYT5C.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccgagccgtgggggtccctgagactctcctgtgcacgtcctcgtgggttcagcatcaagtaacgactaacagtcggacccgtcgggccccgccgagggcctccggagggggaagggggcgtgggtaggtgggttctacgtagtttatagaaacagactcggacactactattaaacttattcgtacgtaccgtccggtagggaaccggggtcccggttacacccctctaccgaaggacacctaccttaaccaaaactactacttcgttataacttcttacgaacctaggtcactaaactaactcgtagacgacgtaaccgacgtacgaccgtcctaacttaatttgttcgcgttcgacattacttcggaacccttaacgctaacgtaacgttcgggacggggtaaccgaagggggaaccc

SEQ ID NO: 366107 - DNA, 604 bp, Homo sapiens
  misc_feature: GZ8MTXP01EKCIV.10.38.D05.1.454.CMB.2.raw
  modified_base (363)..(363): a, c, t, g, unknown or other
  modified_base (542)..(542): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcagcctcgtgggttcagcatcaagtaacgactacatcgacccgtgggccccgccaggcctccggagggggaagggctgggagtgggttctacgtagtttatagaaacngtatcggacactacattaattattctgacgtccggtaggtaacgggtccgttccaccctctcaaggtacacctaccttacccaaaactaactcttcttgtaacttcttacaccaggtcactaacaagttcaggacgacgtaccgacgaccgtaccggccctaacttaatttacgttcgngccgtacgacttagttcgacctgcctaacgtaagtccgggacggggccttaaggggaacccc

SEQ ID NO: 366108 - DNA, 658 bp, Homo sapiens
  misc_feature: GZ8MTXP01AZ5XX.10.38.D05.1.454.CMB.2.raw
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtgcttaataactatgtctctggtaccagcaccaccaggccaaacgccccctaaattcctttgttttgagtcagtaacgcggcctcgacggactccctgtacttcggttctctcgccctacgaagtctggaaccaacgccggccctcccgtcgaccgttctcgtcgggcctccgaggctgaggactggaggtctgtaatttaccgtactgacgacgcggactaagttacttaccgaacggtacccccaagggtacggggttcggttaggggaccgggtagggtaaaccgttaaggggttccggaaccggtttcccggaggggttacccgacgggtaccccggaacgggttcccgttcccgtccccccggttcgggtccctacccgttccgttcccgttccccccggttccccttaaccccg

SEQ ID NO: 366109 - DNA, 664 bp, Homo sapiens
  misc_feature: GZ8MTXP01AKKQH.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacagtcgaccgtcgggccccgccgagggcctccggagggggaagggggctgggagtgggtctcgagtttatagaaacagactggacactacattaattattctgaccgtccggtaggaacggggtcccggttacacccctctccgagacgaccaccttaccaaacaactattccttagtacttccttacaactatcgacaactaaacttcgtaggaacggtacgtaccggaaccgtaaccgacccgggtacccctaacccgtttaatttacggttcggtccggaccggtaccgtaaccttaggttccgttaacccgttaacccggccttaacgtaacgtttccggggcgggggtaaccccgaacgggggtaaccccgg

SEQ ID NO: 366110 - DNA, 689 bp, Homo sapiens
  misc_feature: GZ8MTXP01DW7QD.10.38.D05.1.454.CMB.2.raw
  modified_base (286)..(286): a, c, t, g, unknown or other
  modified_base (319)..(319): a, c, t, g, unknown or other
  modified_base (512)..(512): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcttgggttttccttgttgctatttacaaaaggtgtccactgtgtaggttcaacgtggtggagacgtggaggaggctggactccgaggtccgtgggggtccctgagtactctcctgtgcacgtcctcgtgggtcagcancaagtaacgactacagtcgaccgtcgggccccnccgacggctcggagggggaacgggctgggagtgggtctcgtagttagtagaaacagatggacactacaattaattattcgtagtaccgttccggtaggtaacggggtcccgttacaccccgttctacccaaggactaccaccttaccaaacgaactattcttagtactcttacgaactaggttacaccctaanaactttcgaagaacgacgttaccgaaaccgtccgaaccggtcccctaaacgtttaatttacgttgggtacgccgggtaacgaaccttaacttcggaaaccccttaaccggtacctttaacccgttaaacgggtttcccgggaccggggggaaccccgaacggggggttaacccccgg

SEQ ID NO: 366111 - DNA, 546 bp, Homo sapiens
  misc_feature: GZ8MTXP01EOU9S.10.38.D05.1.454.CMB.2.raw
  modified_base (363)..(363): a, c, t, g, unknown or other
  modified_base (430)..(430): a, c, t, g, unknown or other
  modified_base (453)..(453): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttataactatgtctctgtaccaacaacaccagacaaacgaccccaaactcatgtattttgatgtcagtaatcggcctcgtagggtttctaatcgtcttctctcgctacaagtctcggacaacncggcctccctgacctatctcgtcgggctcgaggctgagacgaggctgtattattactgactagctanatactacaacagcacgctacttntagtacgttcgggaacggacggaccgaagttcgtacgtaccgttccgttagggttaccaacgccccgaaggccctccgccccgtcgttcgtcc

SEQ ID NO: 366112 - DNA, 586 bp, Homo sapiens
  misc_feature: GZ8MTXP01DBK7I.10.38.D05.1.454.CMB.2.raw
  modified_base (388)..(388): a, c, t, g, unknown or other
  modified_base (518)..(518): a, c, t, g, unknown or other
  modified_base (546)..(546): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatcagccgtgggggtcctgagactctcctgtgcagcctcgtggattcgacttacgaaatgtctggcagtgcgacgtcgggtccgccgaggcctaccgaaacggaagggggcgtggaggtgggtggctagtttctttcatttagaataaggaaaaaaggtatattaagngccgaccgtccgtagaacgggccagttcagcatctaccagagactacttaccgaacggaccgacggtgtaactcgtacgaacgaaatcgaaccagccgtagagaagagagtacgacggctatgtaacttnttgttgacgaacgacccttcaccgtaanaaactaagtacggtgggggttacttaaggaacgtaacggg

SEQ ID NO: 366113 - DNA, 554 bp, Homo sapiens
  misc_feature: GZ8MTXP01CD05Q.10.38.D05.1.454.CMB.2.raw
  modified_base (271)..(271): a, c, t, g, unknown or other
  modified_base (288)..(288): a, c, t, g, unknown or other
  modified_base (331)..(331): a, c, t, g, unknown or other
  modified_base (395)..(395): a, c, t, g, unknown or other
  modified_base (408)..(408): a, c, t, g, unknown or other
  modified_base (468)..(468): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctccgagggaaggggctggagtgggtctcagttattgaaacagatggcactacatattatctgactcgngaaggccgttcaccctntccagagacacttccaaacaacatcttgtatcttcacatgcanaatctgagagtcgacgacaacggccaactattatgtgcgcgacatcgactacgctacaattcgnggggccagggacncccaggtccaccgtcctaccccgaactcccaccgaacggcccactccggtcctttccccncggtccgccctcgttccgaacggacgcctacccgacgacgcgcgacgaccgtcggccccgtgggctcgcccgtcggttcgaaccgg

SEQ ID NO: 366114 - DNA, 639 bp, Homo sapiens
  misc_feature: GZ8MTXP01EHLK8.10.38.D05.1.454.CMB.2.raw
  modified_base (240)..(240): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtncttaataactatgtctctgtacagcaccaccagacaaacgccccaattcttgtttgagtcagtacgcgcctagagactcctgtactcgtctctcgcctacagtctcggaacaacgccggtccctcccgtcgacccgttcgtcgtcgggctccgaggtctaggaggagtggaacggtcttagtaacttacgtactgacacgcggtactaattacttccggaaaccggtcccctaaagggttggggtttacggtttcgggaccggggtacggtaacgtaacgggtcgtacccggttcggtcgggttaccgacgggtacccgttaacgggttcccgttcccggtccccgttggtaacccttccgttcccgttcccgtttaaccccccgcccgtttaaccccg

SEQ ID NO: 366115 - DNA, 628 bp, Homo sapiens
  misc_feature: GZ8MTXP01EQIWG.10.38.D05.1.454.CMB.2.raw
  modified_base (274)..(274): a, c, t, g, unknown or other
  modified_base (504)..(504): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcancaagtaacgactacatcgaccgtcgggccccgccgaggcctccggagggggaaggggcgtgggaggtgggtctcgtagttatagaaacagactggactaactactattaaatttattcgtagtaccgtccgggtaggaacggggtcccggttaccacccctcgtaccaagacgacctaacctttaccaaactaactacttcttagtacttcttacactattcgacctaanaactcgtagacgtacgtacgacgtaccgacgccctaacttaattagttggcttcgacgtaacttagttcggaaccttcgacttaacgaacgttcgggacggggcccgttaagggggtaaccccg

SEQ ID NO: 366116 - DNA, 686 bp, Homo sapiens
  misc_feature: GZ8MTXP01DEWYZ.10.38.D05.1.454.CMB.2.raw
  modified_base (280)..(280): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtggaggaggctggatccgagccgtgggggtccctgagactctcctgtgcacgcctcgtgggttcagcancaagtaacgactacatcgacccgtcgggccccgaccgacggcctaccggagggggaagggggcgtgggaggtcgggttctacgtaggtttataggaaacaggtactacgggacctaacttaacctatttaaacgtttatttccgtacgtacccgttaccgggtacggtaaccgggggtcccgtttaccgaccccttctacccgaagacgacctaaccttaacccaaaactaactacttcgttctacttccttaacacctaggtacactaacaacttcgtaggacgtacgtaccggaaccgaccgaacccggtaccttaaccttaatttcgttaggtcgacgacgtacaacgttcgttaaacctcgtctaactaacggttcggacgggtaaccgaacggggtccccg

SEQ ID NO: 366117 - DNA, 646 bp, Homo sapiens
  misc_feature: GZ8MTXP01CULOS.10.38.D05.1.454.CMB.2.raw
  modified_base (484)..(484): a, c, t, g, unknown or other
  modified_base (492)..(492): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgagccgtgggggtccctgagactctcctgtgcagtcctcgtgggttcagcatcaagtaacgactaacagtcgaccgtcggccccgccgacgggcctaccggagggggaacgggggcgtgggagttgggtctacgtagttagtagaaacagatggacacgtacattaaattattctacgtaccgttccggtaggaaccggggtcccggtttaccaccccttctaccaaggtaccaacctaaccttaccaaactaaactnttacgttnttactcttacaaccagttacgactaaacgtaatccgtaggaacgagtaccggactaccgaccgtactacgtaatttagttgtcgcgacgacttaagttcggaacctaacgccttaacgtaacgttccgacgggggtaaccgaagggtaaccccg

SEQ ID NO: 366118 - DNA, 608 bp, Homo sapiens
  misc_feature: GZ8MTXP01BQKTB.10.38.D05.1.454.CMB.2.raw
  modified_base (360)..(360): a, c, t, g, unknown or other
tcagcatagtagtgcacgaccggtgctcgatttagtatctgatagttgggtttggggggagaggagcccagcactgggattccgagttgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccctgggccccgccagggcctccgagggggaacggggctgggagtggggtctcgtagttatagaaacngatggactactacattaattattctgactccgtaggaacggtcgtcaccctctccagacgactacttaccaaactaacacttcttatacttcttacactagtcacctaacaatctaggaagacgtaccgaacgtaccaccggtaccctaaccgttaatttacgttggtcgccgtacgaaccttagttcgaccttaaccggacctaactaactttcgggttcgggggtaacccgaaggggggaaccccg

SEQ ID NO: 366119 - DNA, 872 bp, Homo sapiens
  misc_feature: GZ8MTXP01E1XKU.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggctggatccagccgtgggggtccctgagactctcctgtgcagcctcgtgggttcagcatacaagtaacgactacatcgaccgtcgggccccgccgaggcctacccggaaggggggaaacgggggcgttgggggaggttcgggggttaccttacgtaaggttttaagttaacggaaaaacgtaggtaacgttacggggacctaaaccttaacctaaatttaaaactttttaatttccgttacggtaaacccggtttacccggggtaacggggtaaaccggggggttcccccggggttttacccaaaccccccgttccttaaccccggaaaggtaaacccggaaacccttaaacccttttaaaccccaaaaaaacccgtaaaccttaaactttccgttttaacggttaacttacccttttaaccaaaccgttaaacttcggaaaccctaaaccttaaaattcccgttaagggaaacggtaacggttaaccccggaaacccgtaacccggtaaccccgggaaccccttaaacccgtttaattttaacgttttgggtcgacccgggaccgtaaccttaaggttcgttaaacccttaacgtacccttaacgtaaaacggttttccgggacgggggggtaaccccaaggggggtaacccccg

SEQ ID NO: 366120 - DNA, 646 bp, Homo sapiens
  misc_feature: GZ8MTXP01ESBMP.10.38.D05.1.454.CMB.2.raw
  modified_base (276)..(276): a, c, t, g, unknown or other
  modified_base (611)..(611): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcacgcctcgtgggttcagcancaagtaacgactacatcgaccgtcgggccccgccgaggcctccggagggggaagggcgtgggaggtcgggtctcgtagtttagtagaaacagactggactaactactattaattattcgtagtaccgtccggtagggtaaaccggggtcccggttacaccccgttctaccgaagtaacgaccctaccttaaccaaaacctaacttacttccttagtaacctcttaacaccgtattcgactaaacaactcgtaggaacgtacggtacgaaaccgaccgtaccggtaccctaacttaagtttagttcgcgacgactaacattcgacttaacgctaanaacgttcgggacggggaacccttaagggggaaccc

SEQ ID NO: 366121 - DNA, 553 bp, Homo sapiens
  misc_feature: GZ8MTXP01ECHOC.10.38.D05.1.454.CMB.2.raw
  modified_base (173)..(173): a, c, t, g, unknown or other
  modified_base (219)..(219): a, c, t, g, unknown or other
  modified_base (230)..(230): a, c, t, g, unknown or other
  modified_base (240)..(240): a, c, t, g, unknown or other
  modified_base (360)..(360): a, c, t, g, unknown or other
  modified_base (395)..(395): a, c, t, g, unknown or other
  modified_base (479)..(479): a, c, t, g, unknown or other
  modified_base (486)..(486): a, c, t, g, unknown or other
  modified_base (495)..(495): a, c, t, g, unknown or other
  modified_base (499)..(499): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccnccaggctccgaggggaagggctggagtgggtctcagttatgaaacngatggcactanatattattcngactccgtgaacgggccgttcaccctctccagacgacacttccaaacaacatctgtatcttcacatgacaacaatctagagagtcgacgacacggccaaccttattagtgcgcgacgacntcgaactacgctacaagttcgtaggggccagggcnccgaggtccaccgtcctcccagccctccaaccgaacggcccagttccgggggtcccttccccgtggcccgcctgcctcgaggcncctaccnccgagaacncacncgccggccctgggcttcgccgtggacaacggtctaccttcctaacttcgtaacg

SEQ ID NO: 366122 - DNA, 565 bp, Homo sapiens
  misc_feature: GZ8MTXP01AWDTG.10.38.D05.1.454.CMB.2.raw
  modified_base (554)..(554): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgaccgtgggccccgcaggctccgaggggaggggctgggagtgggtctctagttatgaaacagactggcacgtacattaattattctagacctccggtggaacggggtcccggttcaccctctacccagacgactaccttaccaaactacattcctgtactctcacatcgacacaatctgagagtacgaccgcacggcctaaccgtaattacgttgtagcgaacgacagttcgacctaacgtactctaacttcggcggggaaccnggggtaacccg

SEQ ID NO: 366123 - DNA, 643 bp, Homo sapiens
  misc_feature: GZ8MTXP01CLT4E.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctctgtgcagcctcgtgggttcagcatcaagtaacgactacatcgacccgtcgggccccgccgaggcctaccggagggggaaggggcgtgggaggtgggtctcgtagttatagaaacgagactggacactactattaatttattcgtgtaccgtccggtaggaacgggtcccggttcaccccttctaccgagacgtaccaccttaccaaacaactacgttcttagtaacttccgttacaactacttcgaaccctaactaaagttcctaggacgtacgtaccggaaccgtaccgaccggtaccctaccgttaattagttcggacgccgtaagcagttcggttacctaacggtcctaacgtaacgttcgggacgggggaacccaagggggaaccccg

SEQ ID NO: 366124 - DNA, 613 bp, Homo sapiens
  misc_feature: GZ8MTXP01CLIY0.10.38.D05.1.454.CMB.2.raw
  modified_base (276)..(276): a, c, t, g, unknown or other
  modified_base (363)..(363): a, c, t, g, unknown or other
  modified_base (369)..(369): a, c, t, g, unknown or other
  modified_base (452)..(452): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctcgtgggttcagcancagtaacgactaacatcgaccgtcgggccccgccgaggcctccgagggggaaggggcgtgggagtgggtctcgtagttatagaaacngatggnactacataattattctgactcggtacgacgggtcccggtcaccctctaccagacgaccaccttaccaaactaacattaccttntacttccttacaactagtcaccaacaagttccagaacgacgtaccgaaccgaaccaccggtacccaaccttaattaacgttggtcggcgaccgacttagttcgttaaccctcgtaccttaacgtaacgttcgggttacgggggcccgaaagggggtccccg

SEQ ID NO: 366125 - DNA, 598 bp, Homo sapiens
  misc_feature: GZ8MTXP01AS0E9.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatgaccgtcgggccccgccaggcctccgagggggaacgggggctgggagtgggtctcgagttatagaaacagatggcactacataattattctgtactcggtggaacgggtccggtcacccgtctccagacgacacttacaaactacatcttatactcttacacatcgactaacaatccgtagaacgtagtaccggaacgaccgacggtaccctaaccttaatttagttcgtacggccgtacgaacttacgttcgaacctaacggccttaacgaacgtttccgggacgggggcccttaagggggaaccccg

SEQ ID NO: 366126 - DNA, 672 bp, Homo sapiens
  misc_feature: GZ8MTXP01B1WIH.10.38.D05.1.454.CMB.2.raw
  modified_base (274)..(274): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtgggggtccctgagactctcctgtgcagcctgtgggttcagcancagtaacgactaacatcgaccgtcgggccccgccgaggcctccggagggggaacgggggcgtgggaggtcgggtctcgtaagtttatagaaacagatcggactactaactatttaaactttattcctagtaccgttcccgggttaggaaaccgggggtcccggttacccaccccgttctaccgaacggtacgaacctaccttacccaaaaccaactattacttctacttccttacaacgtagtcactaacaattccgagaacgacggtaccgaacgtaccgaccggtacccacctttaagtttagttcgtcggacgaccgaacttacgttcggaaccctaacggtcccttaagttaacggtcccggttacgggggaaccccgaagggggtaaccccgg

SEQ ID NO: 366127 - DNA, 628 bp, Homo sapiens
  misc_feature: GZ8MTXP01E0YX1.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagccctctgggttcagcatcaagtaacgactacatcgacccgtcgggccccgccagggcctccggagggggaacgggggcgtgggaggtgggtctacgtagtttagttagaaacagactcggactactaacattaaattagttctagaccgttaccgggtaggaaccgggggtcccggttaccacccccgttctacccgagacgaacctaaccttaccaaaactactatccttgtactctacaacagtcgacaacaatctagagacgtacgaccgacaccggaccacttaattattcgtacgcgacgtacacgttcgaccttaaccgcttaacgtaacgttcgggacggggaacccgttaaggggaaccccg

SEQ ID NO: 366128 - DNA, 619 bp, Homo sapiens
  misc_feature: GZ8MTXP01DMYWA.10.38.D05.1.454.CMB.2.raw
  modified_base (467)..(467): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtcctgagactctcctgtgcacgcctcgtgggttcagcatacaagtaacgactacatcggaccgtcgggccccgccgacggcctaccggaaggggggaacggggcgtgggaggttcggggttctacgtagtttatagaaacagatcggacactactattaattacttctagacctccgggtaggtaccgggtccgttccaccctctcgaagacacctacttaccaaacactnttctgtactcttacactatcgactaacaattctagagacgtaccgacgaccaccgcctaacgttaattagttgtcgacgacgtacttaacgttcgaaccttaacgctaacttaacggtccgggttacgggggaaccgaacgggggtaacccg

SEQ ID NO: 366129 - DNA, 603 bp, Homo sapiens
  misc_feature: GZ8MTXP01ERC5T.10.38.D05.1.454.CMB.2.raw
  modified_base (259)..(259): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaactggtggagacgtggaggaggctggatccaggccgtcgggggtcctgagctctctgtgcncgcctcgtgggttcagcatacagtaacgactacatcggacctcgggccccgccacgggccgtacccggaagggggaacgggggcgtggggaggttcggggttctacgtagtttatagaaacagatggactactactattaattattctagactccggtagaacgggtcccgttcacccttctcaagacgactaccttaccaaactaactacttcttagtactctcaacattcgactacagttcagacgtacgacgaccgaacaccggtcctaacctaatttagttgcgttcgacgaccttagttcaactcgactcgaacttcggacgggccgaaggggaacccg

SEQ ID NO: 366130 - DNA, 613 bp, Homo sapiens
  misc_feature: GZ8MTXP01D159Z.10.38.D05.1.454.CMB.2.raw
  modified_base (478)..(478): a, c, t, g, unknown or other
  modified_base (580)..(580): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctgagactctcctgtgcagcctcgtgggtcagcatcaagtaacgactaacatcgacccgtcgggccccgaccgaggcctaccggagggggaaagggggcgtgggaggtcggggtctcgtagtttattagaaacagagtcggactaactactattaattattcgtgtaccgttccggtaggaacggggtcccggttacaccccttctaccgaagacgaacctaccttaccaaaactactnttccttagtactcttacacagtcgacaactaatcgtagagacgtaccgacgaccgaccgcctacgtaatttgttgtcgcgacaacttagttcggactaacgnttcaagttcggcgggtaaccgaaggggaacccg

SEQ ID NO: 366131 - DNA, 637 bp, Homo sapiens
  misc_feature: GZ8MTXP01B20RB.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcaagtaacgactacagtcgaccgtcgggccccgccgagggcctaccggagggggaacgggggcgtggggaggttcggggttctacgtagtttattacggaaacagacgtggactaactacattaattacttctgtaccgtccggtaggaacgggtcccggttaccacccttcgtaccgagacgtacctaccttacccaaaactacgtacttcttagtaacttccttacacagttacgactaactaatccgtagacgacgtaccgaacgaccgacccggtcctaacgttaattaagttggcgcgacgacttagttcggacctaacgctaactaagttccggacggggtccgaagggtaacccg

SEQ ID NO: 366132 - DNA, 935 bp, Homo sapiens
  misc_feature: GZ8MTXP01D4DAB.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccgagccgtgggggtccctgacgactctcctgtgcacgcctgtggtcagcatcgaagtaacgactacatcggacccgtcgggccccgaccgacgggccgtaccggaaggggggaaacgggggtcgtagggggtaacggttcgggggtttaccttacggttaaaggttttaagttaaacggaaaaccgtaggtaacgttacgggtaacctaacgttaaaccttaacgtttaaaattttaaacgtttccggtaacgggttaaccccggtttaccccggggttaacgggggtaaacccggggggtttcccccggtttaaccctaacccccccgttttacgtacccggaaaaccgggtaaaccgtaaaccccgtttaaacccctttaaaccccaaaaaaaccgggttaaaccttaccgttttaccgtttacgttaaaacctttccccgtttaaaccaaacccgttagtttaacccggaaccctaaaaccgttaaactttccccgggtaagggaaacggttaacccggttaaaccccgggaaacccgttaaaccccggaaccccgggttaccccctttaaacttaaagtttttccggttggtaccccggaccgaaccggtaacttacgttaacggttaaaccccttccggtaacctttaaccggtaaacggtttcccgggggaacggggccccggttaacggggggtaacccccg

SEQ ID NO: 366133 - DNA, 753 bp, Homo sapiens
  misc_feature: GZ8MTXP01CW4S6.10.38.D05.1.454.CMB.2.raw
  modified_base (277)..(277): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtgggaggaggctggatccgagccgtgggggtccctgagactctcctgtgcagcctgtgggttcagcancagtaacgactacagtcgaccgtcgggccccgaccgaggcctacccggaagggggaacgggggtctagggggaggttcgggggttacctacgtaaggtttaattaggaaacagtacgtgggacactaacctattaatttacttcgtagaccgttacccgggtacgggaaaccggggtccccggttaccaacccctcgtaccaaggacgaacctaaccttaacccaaaactaaacctattactttacgtacttccttaccaacctagttaccgactaaacctaaagttcctaagggaacgtacgtaacccgggaaccgtaaacccgacccgggtacccttaaacccgtttaatttaaccgttgggtcggttacccgtaccggtaacttacgtttccggaaacctttaacccgggcctttaacgtaaacgttttcccggggttacggggggtaaccccgttaaggggggtaacccccg

SEQ ID NO: 366134 - DNA, 721 bp, Homo sapiens
  misc_feature: GZ8MTXP01A6TW2.10.38.D05.1.454.CMB.2.raw
  modified_base (218)..(218): a, c, t, g, unknown or other
  modified_base (267)..(267): a, c, t, g, unknown or other
  modified_base (283)..(283): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgagggaaggggctggagtggtctcagttattgaaacngatggcactacatattattctgactcgtgacggccgtcacctctcaganacacttccaacaactntcttgtatcttcacatcgacaactaatcgtagaagtacgtacgaacgacgaccggcctaacccttattagtgtcgccgacgacaagtcgaacctacgccttacgtaacttcgggtcgggaccgaggggaccgacccgtagggtcccaacccggttcccctaccccgaccgtacccctaccccgaacccgaaacccggggtcccctaaccgttccccgggggttcccccgtttccccccgtcgggcccccgtccccgttccggccccttacccggaacggaccgccccgtaaccccgtccgggaacggaacgacccaaaccggtccgggccccgggtccccgttcggggccccgtttcgggccccggtttaacggtaacccggtaaaccggggtaccctttaaccccggttacccctaaacccgttaactttaacccgg

SEQ ID NO: 366135 - DNA, 779 bp, Homo sapiens
  misc_feature: GZ8MTXP01CLEDV.10.38.D05.1.454.CMB.2.raw
  modified_base (274)..(274): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcancaagtaacgactacatcgacccgtcgggccccgccgacgggcctaccggagggggaacgggggcgtggggaggttcggggttctacgtagtttaagttaggaaacgaggacgtcggactaacttaactaatttaaactttatttccgtagtaaacccgttccgggtagggaaaccggggtccccgggtttaccaacccccgttctacccgaagggtaacctaccctaaacctttaccccaaaactaacctatttcctttagtaacttcccttacaaacgtagttacgaccctaaactaaacgttcgtaagggacgtaaaccggtacccggaaacccgaaacccgtaaccccggggtaccccttaaaccctttaagttttaagtttcggggccgacccgggaaccgtaaccttaaggttccgggaaacccttaacccggtcctttaaccgtaaacgggttttccccggggaacgggggggaacccccaaaggggggtaaccccccg

SEQ ID NO: 366136 - DNA, 583 bp, Homo sapiens
  misc_feature: GZ8MTXP01D5LBY.10.38.D05.1.454.CMB.2.raw
  modified_base (466)..(466): a, c, t, g, unknown or other
  modified_base (550)..(550): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagcgtgggttttccttgttgctattcaaaaggtgtccactgtgaggttcaactggtggagactggaggaggctggatccgagccgtggggggtccctgagctctcctgtgcagcctcgtgggtcagcatcagtaacgactacatgaccgtgggccccgcaggcctccgaagggggagggggctgggaggtcgggtctacgtagttagttagaaaccaggatggactaactaaacaatttaattaatttctacgtacctcggtaggacggggtcccgtttaccacccgtctcgaagacactaccttacaacacatcgttntactcttcactagtcactaactaactcgtagaaacgtcgtacgaaccgcgaacccggtctaccgttattacgttgcgcgttcgnactgaactcgtctattacgttcggcgggaaccg

SEQ ID NO: 366137 - DNA, 491 bp, Homo sapiens
  misc_feature: GZ8MTXP01CRY9O.10.38.D05.1.454.CMB.2.raw
  modified_base (239)..(239): a, c, t, g, unknown or other
  modified_base (314)..(314): a, c, t, g, unknown or other
  modified_base (472)..(475): a, c, t, g, unknown or other
  modified_base (477)..(491): a, c, t, g, unknown or other
tcagcatagtagtgcacgaccggtgctcgatttagtatctgatagttgttggaagtgtctctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcgnggggccaggggacgcccgaggtccacccgtcctcccccagccctccaccaacgggcccatccggtccttcccccnggccgcccctgcctccgaggacgccaccctccggaagacgccaacccgacggccggccccgtggggccctcggcccgtgggtaccaaacgggtaccttaccgtccccaacttactagtcgcgtggacggtcgggctcgggacaagggccgacaagtgnnnngnnnnnnnnnnnnnnn

SEQ ID NO: 366138 - DNA, 622 bp, Homo sapiens
  misc_feature: GZ8MTXP01BIBA9.10.38.D05.1.454.CMB.2.raw
  modified_base (303)..(303): a, c, t, g, unknown or other
  modified_base (356)..(356): a, c, t, g, unknown or other
  modified_base (455)..(455): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcaagtaacgactacatgaccctgggccccnccaggcctccgagggggaaggggctgggaggtgggtctcgagttatagaaacngatggcactacataattattctgacctccggtaggaacggggtcccggttacacccctctaccagacgacctaccttaccaaactaactagttcctttntaacttccttacaaccgtaagttcgaccaaacctaaattccgtaggaacggtacgtaacccggaaccgtaacccgaccggtacccctaacccttaatttaacgttggtcgcggacgaaccagttcgaccttaacgctaactaagttccgacgggggtccaagggccc

SEQ ID NO: 366139 - DNA, 737 bp, Homo sapiens
  misc_feature: GZ8MTXP01EDTYY.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtggaggaggctggatccgagccgtgggggtcctgagctctctgtgcacgcctcgtgggtcagcatcaagtaacgactacatcgaccgtcgggccccgccgaggcctaccggagggggaacggggcgtaggggtaggttcggggttactacggttaagtttaagttacggaaaacgtaggtaacgtcggtacctaacgtaaactaatttaaactttactttcgtacggtaacccgttccgggtacgggaaacccggggttccccggttacctacccccttctacccgaaggacctaacctaaccttacccaaaactactattccttagtaacttcttacaactagttcgacctaaactaacgtccgtaggaacgttacggaccgaaccggaaccctacccggtaccctaaccgttaaatttcgttcggtcggcccgaaccgtaacttacgttcgaaacccgttcccggtacttaaccgtaaacggtttccgggacgggggtaaccccgaacggggggtaacccccg

SEQ ID NO: 366140 - DNA, 608 bp, Homo sapiens
  misc_feature: GZ8MTXP01ET6GA.10.38.D05.1.454.CMB.2.raw
  modified_base (372)..(372): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccacggccgtgggggtccctgagactctcctgtgcacgcctcgtgggttcagcatcagtaacgactacagtcgaccgtcgggccccgccgaggcctaccggagggggaacgggggcgtgggaggtgggtctcgtagtttattagaaacngactggactactactataattacttcgtacgtacgtccggtaggaaccggggtccgttacacccttctaccgaagacgactacctccaaacaactatcttagtactacttacacatcgacactaatcgtagacgacgtacgaccgtaacgaccggtcccaacttaattagttgcgacgcgaacagttcgacctaacgctaacgtaacgttcggacggggtccgaacggggaacccg

SEQ ID NO: 366141 - DNA, 634 bp, Homo sapiens
  misc_feature: GZ8MTXP01A1I3D.10.38.D05.1.454.CMB.2.raw
  modified_base (257)..(257): a, c, t, g, unknown or other
  modified_base (360)..(360): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcngcctcgtgggttcagcatcagtaacgactacatcgacccgtgggccccgcgacggcctccggaagggggaggggctgggagtgggtctcgagttatagaaacngactggacactacataattattctgacctccggtaggaacggggtcccgttacacccctctaccaggacgacctaccttaccaaactactattccttagtacttcttacaacagtcgactaacaaatcctaggacgtacgtaccgaacgtaaccgaccggtaccctaaccggttaatttaacgtttcggcgaccgtacgaaccttagttcgaaccgttaaccgaccttaacgtaaacgtttccgggacggggaacccgttaagggggaaccccg

SEQ ID NO: 366142 - DNA, 682 bp, Homo sapiens
  misc_feature: GZ8MTXP01ASRS2.10.38.D05.1.454.CMB.2.raw
  modified_base (226)..(226): a, c, t, g, unknown or other
  modified_base (312)..(312): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgtactttgtgcttataactatgtctctggtacagcaccaccagcaaacgccccaatccttgtttgagtcagtacgcgcctnaggacgtcctgatcggttctctcgcctacgtaagtctacggaaccaaccgccggccctcccgtagaccccgtctcgtcgggcctccgaggctagacggagtgaggtcttaggtactttactaacgtgacgaaggcggactaagttacgttaccgaccggtaccccgaaacggtacggggtttggtttcggggccgggtaccggggtaacgttaaacgggggtccgtaacccggttccggtacggggttaccgaaccgggtccccggaaacgggttccccttaccccggggtcccccccgttaccggggtccccttaccccgttcccgttaccccggtttaaccccccgttaacccccgttttaacccccg

SEQ ID NO: 366143 - DNA, 610 bp, Homo sapiens
  misc_feature: GZ8MTXP01EOF9O.10.38.D05.1.454.CMB.2.raw
  modified_base (449)..(449): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccctcgggccccgccagggcctccggaggggaagggggctgggagtgggtctctagttatagaaacagatggacactactattaattattctgtactccggtaggaacgggtccggtcaccctctacagacacaccttacaaacaactattccgttntactcttacaacgtattcgacaaacctatctaggacgtagtaccgaacgacgaccgacctaaccttaatttacgttggtacgcgaccaacttagttcggaaacccttaacggctttaacgtaacgttccgggacgggggtaaccccaaggggggaaccccg

SEQ ID NO: 366144 - DNA, 613 bp, Homo sapiens
  misc_feature: GZ8MTXP01DQQJS.10.38.D05.1.454.CMB.2.raw
  modified_base (398)..(398): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgagccgtgggggtccctgagactctcctgtgcagcctcgtgggttcagcatcaagtaacgactaacatcgacccgtcgggccccgcccgaggcctccggaagggggaagggggctgggaggtgggtctcgtagttattagaaacagatggactactacattaaattattcgngtacctccggtagaacgggtccgtaccaccctctaccaggacacaccttacccaaacaactatcttatacttcttacacgtatcgactaaccaatcgtagagacgtaccgacgacaccggacctaccgttaattagttgcgttcgacgacacgttcgaaccgtcctactaaccgtaacgttcggttacgggggaacccgaacgggggtaaccccg

SEQ ID NO: 366145 - DNA, 550 bp, Homo sapiens
  misc_feature: GZ8MTXP01CSCG2.10.38.D05.1.454.CMB.2.raw
  modified_base (512)..(512): a, c, t, g, unknown or other
  modified_base (531)..(531): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctaccgaggggaagggggctgggagtgggtctcaggttatggaaaaccaggatggcactaacataattattctgactccgtgaaacgggccgttcaaccccttcgccagaacgacaaccttccaaactaacattcttataatctttacacaattcacacaaatctagagagtcgacgacacggtccaacttagttattgtcgngaccgacataacactaacnctacttactcgttcgggcg

SEQ ID NO: 366146 - DNA, 683 bp, Homo sapiens
  misc_feature: GZ8MTXP01C7BB2.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtggggggtccctgacgactctcctgtgcagcctcgtgggttcagcatcaagtaacgactacagtcgaccgtcgggccccgccgaggcctaccggaagggggaagggggctgggaggttggggtctctagttaatagaaacaggatggactactaacatttaaactttattcgtacgtacccgttccgggtacgggaaaccggggtccccggttacgaccccctcgtacccaggacgaacctaccttacccaaactactacttccttgtaacttcttacaactattcgaactaaactaacgttcctaaggaacgtacggtaccgaaccgtaaccgaccccggtacctaaaccttaagtttacttcgggtacgccgtacggtaacttacgttcggaaccttaacggcttaacgtaacgtttcggacgggggtaacccgaacgggtaaccccgg

SEQ ID NO: 366147 - DNA, 630 bp, Homo sapiens
  misc_feature: GZ8MTXP01EKE4D.10.38.D05.1.454.CMB.2.raw
  modified_base (307)..(307): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccgagccgtgggggtcctgagactctcctgtgcagcctcgtgggttcagcatcaagtaacgactacatcgaccgtcgggcccnccgaggcctccggagggggaagggctgggagtgggtctcgtagtttatagaaacagactcggactactaactattaaactttacttcgtacgtacgttccgggtagggtaaccggggtcccggttaccaccccgtctaccgagacgacctaccttaccaaactaactatcttagtactcttacacgatacgacaactatctagagtacgtacggaccaccacggtaccctaccgttaattcgtttaggcgcgacgtaaccttagttcgaacctaacggtcctaacgtaacggttcggcgggggtaaccaagggggtaaccccg

SEQ ID NO: 366148 - DNA, 637 bp, Homo sapiens
  misc_feature: GZ8MTXP01DSYAP.10.38.D05.1.454.CMB.2.raw
  modified_base (363)..(363): a, c, t, g, unknown or other
  modified_base (379)..(379): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcagcctcgtgggtcagcatcagtaacgactacatgaccgtcgggccccgccaggccgtccgagggggaggggcgtgggaggtgggtctcgtagttatagaaacngatggcactaacattnttattctgtacctccggtaggaacggggtcccgttaccacccgttctacccgaagacctaacctaccttaccaaactaacctattccttagtacttccttacaactattacgacctaactaaacttcgtaggaaacgtacggttaccgaaccgtaccgacccgggtaaccctaaacctttattaacgttcggtcgccggttacgacttacgttaacgaactccgtactacgttaacgtttccgggcgggggaacccgg

SEQ ID NO: 366149 - DNA, 642 bp, Homo sapiens
  misc_feature: GZ8MTXP01AZ04V.10.38.D05.1.454.CMB.2.raw
  modified_base (275)..(275): a, c, t, g, unknown or other
  modified_base (369)..(369): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctcgtggtcagcancaagtaacgactacagtcgaccgtcgggccccgccgacggcctccggaagggggaacgggggcgtgggaggtgggtctcgtagttatagaaacngactggacactactattaattacttcgtcgtaccgtccggtaggaaccgggtcccggtaccacccctctacccgaggaaccgactaaccttacccaaactactacttcgttactacttccttacacgtaggttcaacctaataacgtctaggagtacgtaccgaacgaccgtaccggtcctaaccgttaatttacgttcggtacaccgtaacaacgttcgttcgacttaacgctaacgtaagttccgggacggggtccgaacggggtaacccg

SEQ ID NO: 366150 - DNA, 655 bp, Homo sapiens
  misc_feature: GZ8MTXP01EJMMT.10.38.D05.1.454.CMB.2.raw
  modified_base (348)..(348): a, c, t, g, unknown or other
  modified_base (369)..(369): a, c, t, g, unknown or other
  modified_base (397)..(397): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctgggccccgcaggctccgaggggaagggctggagtgggtctcagttatgaaacngatggcatacataattattcngactcggtgaacgggtccgttcaccctntccagtacgacaccttacaaacactattccttagtacttcttacaccgtagttacacctaaacctaagttcctaaggaacgtacggttacccggaaaccgtaacccgaacccggggtaccccctaacccgtttaaacttttgtttcggggtcgaccccgggacggtaaacccttaagttcgggaaaaccccttaaccggtccttaaccgtaaacgtttccggggacggggggtaacccccaagggggggtaacccccg

SEQ ID NO: 366151 - DNA, 718 bp, Homo sapiens
  misc_feature: GZ8MTXP01BQ79E.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtggaggaggcgtggatccgagccggtggggggtccctggagactctccgtgtgcacgcctcgtggtcagcatcaagtaacgactacagtcggacccgtcgggccccgccgacgggcccgtaccgggaagggggaaacgggggcgtaggggtacggttcgggggtctacgtaaggtttaacgtaagaaacgagtaacgtacggactaacctaataattaaactttacttcgtacgtaccgttcccgggtaacgggtaaccggggtccccggttaccaccccgttcgtaccgaacgacgtaccctaacttaacccaaactaaacgtcttaccgttataacttcttacaactatcgacctaaacaattccgagaaggtctaccggaaccgaccgtacccggtacctaacttaagtttattcgggacgccggtacgtaccttaggttcgaacccttccgtctaaacccgttaacggttccggggacgggggtccccgaaagggggtcccccg

SEQ ID NO: 366152 - DNA, 614 bp, Homo sapiens
  misc_feature: GZ8MTXP01B5NKV.10.38.D05.1.454.CMB.2.raw
  modified_base (276)..(276): a, c, t, g, unknown or other
  modified_base (474)..(474): a, c, t, g, unknown or other
  modified_base (583)..(583): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagcctcgtgggttcagcancagtaacgactacagtcgaccgtcgggccccgcgaggcctaccgagggggaacggggctgggagtcggggtctcgtagttatagaaacagactcggacaactactataatttattctacgtactccggtaggaacggggtcccgttcacccctctaccgacgaacgtaccaaccttaccaaacctaactacttacttntacttcttacgaacctagtacgaccaaacctaatccgtagaggtacgtacgacgaccgaccgacctaaccttaagttacttggtcgcgtacgacttagttcgaacgtcnctaactaagttcggacgggccgaacggcccg

SEQ ID NO: 366153 - DNA, 694 bp, Homo sapiens
  misc_feature: GZ8MTXP01AIQST.10.38.D05.1.454.CMB.2.raw
  modified_base (282)..(282): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtgggaggaggctggatccgaggccgtgggggtccctgagactctcctgtgcagcctgtgggttcagcancagtaacgactacatcgaccgtcgggccccgccgagggcctaccggagggggaacggggctgggagtgggtctacgtagtttatagaaacagactggactaacgtacattaaatttacttcgtagtaccgttccgggtacgggaacgggggtccccggttaccaacccccttcgtacccgaaggaaccgtaaccctaaccctttaacccaaaacctaaccttaactttccgtttaattaaccttcctttacaacctagttcgacctaactaatccgtgaacggtacgtaccggaaccgtaccgaacccggtacctaacctttaattacgtttgggacgccgttacgaacttcgttacgaacctaacggtcctaacgtaacggttcggcgggggaacccttaagggggaaccc

SEQ ID NO: 366154 - DNA, 699 bp, Homo sapiens
  misc_feature: GZ8MTXP01B5E8Q.10.38.D05.1.454.CMB.2.raw
  modified_base (303)..(303): a, c, t, g, unknown or other
  modified_base (352)..(352): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcatcagtaacgactacatgacctgggccccncaggctccgagggggaagggctgggagtgggtctcagtttatagaaacngatggcactacattaattattctgtacctcccggtagaacggggtccccggttaccaccccttctacccgaaggtaacgaaccctacctttaccccaaaaactaacctatttccgtttagtaacttccctttacaaccgtaattcgaacctaaactaaacgttcccgtaggaacggtacggttacccggaaaccgaaaccgtaacccggggtaccctaaacccgtttaacgtttaaggttcgggtacggaccggtaccggaaaccttagttccgggaaacctttaaccggcctttaacgtaaaacggtttccggttacggggggtaaccccgaaggggggtaacccc

SEQ ID NO: 366155 - DNA, 703 bp, Homo sapiens
  misc_feature: GZ8MTXP01BFX8I.10.38.D05.1.454.CMB.2.raw
  modified_base (276)..(276): a, c, t, g, unknown or other
  modified_base (340)..(340): a, c, t, g, unknown or other
tcagcatagtagtgcacgaccggtgctcgatttagtatctgatagttgggttttccttgttgctatttcaaaaaggtgtccactgtgaggttcaactggtggagactggaggaggctggatccagccgtggggggtccctgagactctcctgtgcagcctctgggttcagcatcagtaacgactacatgacctgggcccgccaggctccgaggggaagggctggagtgggtctcagttatgaaacagatggacactacatattattctgactccgnggaacgggtccgttcaccctctccagagacaccttaccaaacactatcttagtattcttcactntgacacaatctagagacgtacgacgaccaaccggacctaaccgttatttacgtgacgtacgacgaactagtacgaactaccggtctacgtaaacgttcggtacggggggaccaacgggggaccgccccgtaggggttccccaacccggttccccgtacccccggaacggtcccccttaaccccgaaccccggaacggggtccccctagttccccggggtttcccctttccccccggtggggcccctccccgttgccccgtaccccggaagggccccgcccgtaacccggtccggaacggccgacccgaacccggccgggccccgggtcccgggtgggttccccgtccgggttcccgtaacggg

SEQ ID NO: 366156 - DNA, 634 bp, Homo sapiens
  misc_feature: GZ8MTXP01BEDAC.10.38.D05.1.454.CMB.2.raw
  modified_base (356)..(356): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacatcgaccgtgggccccgcgaggctccgagggggaaggggctgggagtgggtctcgtagttatagaaacngactggacactacattaattatcgtgacctccggtagaacggggtccgttccaccccttctaccaggacgactaccttaccaaactaactattccttgtacttccttacacattacgaccaactaagtccgtaggaacgtacggtaccgaaccgaccgaccgggcccctaaacgttaatttacgttggacggcgaccggtaacttacgttcgaaccttaaccggtcttaaccgtaaacgtttccgggaccggggggaacccttaaggggggaaccccg

SEQ ID NO: 366157 - DNA, 741 bp, Homo sapiens
  misc_feature: GZ8MTXP01CBX71.10.38.D05.1.454.CMB.2.raw
  modified_base (283)..(283): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtggaggaggctggatccgaggccgtgggggtccctggacgctctcctgtgcacgcctcgtgggtcagcancaagtaacgactacatcgacccgtcgggccccgccgacggccgtaccggagggggaacgggggcgtgggaggtcgggtcctagtagttatagaaacagtacgtcggactaacgtaacaattaacttactttcgtacgtaccgttacccgggtacggaaccggggtccccggttacccaacccccgttcgtacccgaaggaaactaccctaaccctttaacccaaaaccttaactatttccgttacttaacttccttaccaactacgttacgaaccaaacctaaacgttccgtaaggaacggacgtaacccggaacccgtaacccgaacccggtacccttaacctttaagtttaacgttcgggccggaccgtacgtaaaccttagttaccgacccgttaacctccgttaaccgtaacggtttcccggggacgggggtaacccgaaccggggggtccccg

SEQ ID NO: 366158 - DNA, 642 bp, Homo sapiens
  misc_feature: GZ8MTXP01DPMWS.10.38.D05.1.454.CMB.2.raw
  modified_base (276)..(276): a, c, t, g, unknown or other
  modified_base (580)..(580): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaaactggtggagacgtggaggaggctggatccgagccgtggggggtccctgagactctcctgtgcagcctgtgggttcagcancagtaacgactacatcgaccgtcgggccccgccgaggcctccggagggggaaggggcgtgggaggtgggtctacgtagttatagaaacagacgtggacaactaactattaaattacttctacgtaccgtccgggtagggaaccggggtcccggttaccaccccttcacccgaaggaacacctaccttacccaaaactactattccttagacttcttacactatcgaactaaacgtatccgtaggaacgtacggtacccgggaactaacccgaccggtaccctaaactttaagtttacgttgggngttcgacgtaacttgttacgacctaacgctaacgtagttcgggacggggccgaagggggccc

SEQ ID NO: 366159 - DNA, 631 bp, Homo sapiens
  misc_feature: GZ8MTXP01B0A9P.10.38.D05.1.454.CMB.2.raw
  modified_base (521)..(521): a, c, t, g, unknown or other
  modified_base (553)..(553): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtggaggaggctggatccagccgtgggggtccctgagactctcctgtgcagcctcgtgggttcagcatcaagtaacgactacatcgacccgtcgggccccgccgacggccgtccggagggggaagggggcgtgggaggtgggtctacgtagttatagaaacagacgtcggacactactattaaattacttcgtacgtaccgttccggtacgggaaccggggtcccgttacctaccccttctaccgaacggtacacctaaccttaccaaaacactattcgtttatacttcttacactagtcgactacctatcgngacgcgtacgactacgaccgcctacttaattnttggtcgcgacgtacttacgttcgaccgttcgcgttaacgtaacgttcgggacgggggaaccgttaaggggaaccccg

SEQ ID NO: 366160 - DNA, 592 bp, Homo sapiens
  misc_feature: GZ8MTXP01D15A9.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatgacccgtgggccccgccaggctccgaggggaaggggctgggagtgggtctcgagttatagaaacagatggacactacattaattattctgacctccggtagaacgggtccggtcaccctctacagacactacttaccaaacaactattcttagtactccttacactatcgacaacaattcgtaggagacgttacgaacgtaccaccggtacccaccgttaatttacgttgtacgcgacgaacttagttcgaaccttcgactcgtaaacgttccggttcgggggaacccaagggggtaaccccg

SEQ ID NO: 366161 - DNA, 683 bp, Homo sapiens
  misc_feature: GZ8MTXP01EH88M.10.38.D05.1.454.CMB.2.raw
  modified_base (274)..(274): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtcctgagactctcctgtgcacgcctgtgggtcagcancaagtaacgactacatcgacccgtcgggccccgaccgacgggcctaccggaagggggaacgggggtccgtagggggacggttcgggggtttctacgtaaggtttaagttaggaaaacgaggtaagtcggactaacttacaatttaaactttaacttcgtacgtacccgtcgggtacgggtaaccgggtcccggttactaaccccgttcacgaacggacaacctaccttaaccaaactaactactcttatacttaccttacactagtacacctaaactatacgtaggaacgtacgaaccggaccaaccgtacccggtacctaaccttaagtttagttcggcgcgacgacttagttcgaccctaacgtactaacgtaacgtcggggttaccgggaaccgaacgggaacccg

SEQ ID NO: 366162 - DNA, 653 bp, Homo sapiens
  misc_feature: GZ8MTXP01DDKO9.10.38.D05.1.454.CMB.2.raw
  modified_base (173)..(173): a, c, t, g, unknown or other
  modified_base (416)..(416): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccncaggctccgagggaagggctggagtgggtctcagttatgaaacagatggcactacatattattctgactccgtgaacgggccgttcaccctctaccagacgaccacttaccaaacaactattccttgtaacttccttacaactatcgacaacaattcgtagaagacgtcgaccgaacgacggacccctaaccttattagttgtacgcgaaccgaatcgtgaacctacgctacgtaattcgggngggacccgagggaccgcccgagggtcccaacccgtctacccccaggacccctaccaaccgaacgggccctacgttccggggtcccttcccccgtggcccacccgtcgccctcgaaacggcacccgaccgtccgagaacgccgaacgtccggcccggtcccgtcgggaccgttcgggcccgttcggggaaacctaaccgggtaaccttaccccgttacccctaacttaaccgttaacg

SEQ ID NO: 366163 - DNA, 656 bp, Homo sapiens
  misc_feature: GZ8MTXP01EX3OZ.10.38.D05.1.454.CMB.2.raw
tcagcatagtagtgcacgaccggtgctcgatttagtatctgatagttgggtttggggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagacgtggaggaggctggatccgagccgtgggggtcctgagactctcctgtgcagcctcgtgggttcagcatcaagtaacgactacatcgacccgtcgggccccgccgagggcctaccggaagggggaacgggggctgggaggtgggtctacgagtttataggaaacagacgtggacaactacattaaatttattctagaccgtccggtaggaacgggtcccggttcacccctctaccagacgacctaccttaccaaacactatccttagactcttacactagtcgaccaaactacgttcgtagaacgtacgtccggaacctacgaacccggtccctaaaccttaagtttactttgggcgttacggacgtaaccttaggttcgttaaccgttccggtaccttaaccgtaaacgtttcccgggacggggggtaaccccgaagggggtaaccccg

SEQ ID NO: 366164 - DNA, 657 bp, Homo sapiens
  misc_feature: GZ8MTXP01B6WEM.10.38.D05.1.454.CMB.2.raw
  modified_base (303)..(303): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgaccgtgggccccnccgaggctccgagggggaaggggctgggagtgggtctacgtagttatagaaacagactggactacgtacattaattacttctcgtaccgtccggtacggaaacggggtcccgggttacaccccttctaccgagacgacctaccttacccaaactaactacttacttcgtacttcttacactactcgactaactaaagttccaggaacgaggtacccgaacgaaccgtaccgggaccctaacccttaagttaacgttggtacgaccggtacccgtaacgttacgttcggaacctaaccggtacctaacgtaaacggttccgggttcgggggtaacccgaacggggggtaaccccg

SEQ ID NO: 366165 - DNA, 694 bp, Homo sapiens
  misc_feature: GZ8MTXP01CKKV9.10.38.D05.1.454.CMB.2.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacttttgtgcttataactatgtctctgtaccagcaccaccagcaaacgccccaaattcctttgtttgagtcaggtaacgcggaccctgacggacgtccctagtacttcggttctcgtcgccctacgaagtctacggaacccaaccgcccggcccttcccgtcgaccccgttctcgtcggggccctaccgagggtcctagggaggtactagggacggtcttagtacttaccacgtgactaggcgacttaagtcttacccgaacggtaccccgaaaggttaggggtttcggttacggggtacgggaccgggtaaacgttaacgggggtccgtaacccggttccgggtacgggttaccgaaccggccccggttaaagggcccctttccccggggcccccctttggggtaaccctttacccgttcccggttaccgtttcccccccgaacccccgttttccccg

SEQ ID NO: 366166 - DNA, 710 bp, Homo sapiens
  misc_feature: GZ8MTXP01COBE2.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggctggatccgagccgtggggggtccctgagactctcctgtgcagcctcgtgggttcagcatcagtaacgactacatcgacccgtcgggccccgccgagggcctaccggagggggaacggggctgggagtgggtctcgtagttatagaaacagactggactactactattaattacttctagtacctccgggtaggaacggggtcccgttcaccccttctaccaagacgacctaccttacccaaactaactattcttagtacttcttacaactagtcgacctaacaaagttccgaggaacggtacggtacccggaaaccggtacccgaaccgggtccccttaaacctttaagtttaacgtttcggggtaccggacccggtaaccggtaacttaacggtttccggaaaccccgtttaaccgggcccttttaaccggtaaacggttttcccgggggaaccgggggggaaccccgttaaacggggggggtaacccccg

SEQ ID NO: 366167 - DNA, 660 bp, Homo sapiens
  misc_feature: GZ8MTXP01ESZ43.10.38.D05.1.454.CMB.2.raw
  modified_base (597)..(597): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccatgtgaggttcaactggtggagacgtggaggaggctggatccgacgccgtgggggtccctgagtactctctgtgcacgcctgtgggttcagcatacaacgtaaccgactacagtcgacccgtcgggccccgccgacggccgtaccggaagggggaacgggggcgtagggggaggttcggggtacttacgtaacgtttaagttagaaaacgagtaacgtacggactaactactaatttaaattacttcgtacgtaccgtccggtacgggtaaccgggtcccgggtacctaccctctacccgaagaacgtacctaacctacctaaaacactaacttcttagttacttctactacactacgacaactacgttcacgagacgtacgaccgacgaccgacctaacctaattagttcggnacgcgtacacgttcaccgtaacgctaacgtaacgttcggacggggtcccggaagggaacccgg

SEQ ID NO: 366168 - DNA, 638 bp, Homo sapiens
  misc_feature: GZ8MTXP01A5M4T.10.38.D05.1.454.CMB.2.raw
  modified_base (388)..(388): a, c, t, g, unknown or other
  modified_base (447)..(447): a, c, t, g, unknown or other
  modified_base (567)..(567): a, c, t, g, unknown or other
  modified_base (629)..(629): a, c, t, g, unknown or other
  modified_base (635)..(635): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgcaggctccgaggggaagggctggagtgggtctcagttattagaaacagatggacactacattattattctgactcgtaggaacgggtccgttcaccctctaccgagacgactacttaccaaactaactattccttagtacttccttacgactatcgacaactaatcgtagaagacgtccgaaaccgaccgaccggacctaacctttagttacgttcgngccgacgaacagtcgactacgcttacgaagtttccgggcggggaccacgggggtacccncccggtacgtaccctacccgtccctaccccgacgtcccctacccgaaaccggaccgtcccctacgttccccggttccccgtccccggtcggcccctccgtcgcccgtacggacggacccncccgtaccgcggacgctaaccgacgcggccgccgtggcttcgcgttagaacacgtccttccncactgngcg

SEQ ID NO: 366169 - DNA, 668 bp, Homo sapiens
  misc_feature: GZ8MTXP01BK16Q.10.38.D05.1.454.CMB.2.raw
  modified_base (476)..(476): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcacgcctcgtgggttcagcatcaagtaacgactacatcgaccgtcgggccccgcaggcctccgagggggaaggggctgggaggtgggtctcgagttatagaaacagactggacactactattaaatttacttcgtgtaccgtccgggtagtaaccgggggtcccgttacacccccttcgtacccaggaacgacctaacccttaccaaaccaactattcttntacttccttacaactatacgacaactaacgttcaggaagacgtccgaacgacccgtaaccggacccttaacctaagttttacgttcggtacgttaccgaccgggtaaccttagttcggaaacccttaaccggtctttaaccgtaaacggtttccgggttacggggggtaaccccaacggggggtaaccccgg

SEQ ID NO: 366170 - DNA, 687 bp, Homo sapiens
  misc_feature: GZ8MTXP01DOPQG.10.38.D05.1.454.CMB.2.raw
  modified_base (276)..(276): a, c, t, g, unknown or other
  modified_base (524)..(524): a, c, t, g, unknown or other
  modified_base (642)..(642): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggctggactccgagccgtgggggtcctgagactctctgtgcacgcctcgtggtcagcancaagtaacgactacagtcgaccgtcgggccccgcgacggcctacggaagggggaacgggcgtgggaggttcggggttactacgtagtttaagttaacggaaacgtaggaccgtcgggactaacttaactaactttaaatttacttcgtacgtacccgttaccgggtacgggtaccggggtcccggttaccaaccccttctacgaacggaacaccctaaccttaacccaaaactaactcttacgtttanacttacctacgaactatacgacaaacctaatccgtaggaacgtcgtaaaccgccgtaaccgaccggtacccttaacgttaattcgttggacgcgtacgattacgttcgaaccttaacncgttaactacggtttcgggacgggtaacccggaagggtaaccccg

SEQ ID NO: 366171 - DNA, 681 bp, Homo sapiens
  misc_feature: GZ8MTXP01CZECH.10.38.D05.1.454.CMB.2.raw
  modified_base (281)..(281): a, c, t, g, unknown or other
  modified_base (618)..(618): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtggaggaggctggatccgaggccgtgggggtccctgagactctcctgtgcagcctcgtgggtcagcancaagtaacgactaacagtcgacccgtcgggccccgaccgacgggccgtaccggaaggggggaacggggcgtgggggaggttcggggtctacgtagtttagtaagaaacgagtacgtcggactaactaataattaaatttaacttcgtacgtaaccgttccgggtacgggaaccgggtcccggttaccaccccgtctaccaaggtaaccaacctaaccttaacccaaaactaactacttaccttataacttcttacaaccgataccgtaacaactaactcgtagaagtacgtaaccgaaccgtaccgacccggtacctaacttaagttagttcggacncggtacaacttacgttcgacctaacgtcttaactaacgttccggttagtccggccgtaacggg

SEQ ID NO: 366172 - DNA, 628 bp, Homo sapiens
  misc_feature: GZ8MTXP01D5BE6.10.38.D05.1.454.CMB.2.raw
  modified_base (457)..(457): a, c, t, g, unknown or other
  modified_base (485)..(485): a, c, t, g, unknown or other
  modified_base (496)..(496): a, c, t, g, unknown or other
  modified_base (521)..(521): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcagcctcgtgggttcagcatcaagtaacgactacatcgaccgtcgggccccgaccgacggcctaccggaagggggaacgggggcgtggggaggtcgggggttactacgtaagtttaattaggaaacagtacgtcggactaactaactattaaattacttcgtagtaccgtccggtaggaaccggggtcccgtcaccccttntaccaaggacacctaccttaacccaaanactattcttanacttcttacgactaggtcacctaanaactgagagtacgtaccgaccacgaccgacctaacgtaattgcgtcgcgagtaacagttcgaactcgactcgtaacgttcgggacgggaacccgaaggggtaacccc

SEQ ID NO: 366173 - DNA, 579 bp, Homo sapiens
  misc_feature: GZ8MTXP01D0N45.10.38.D05.1.454.CMB.2.raw
  modified_base (303)..(303): a, c, t, g, unknown or other
  modified_base (356)..(356): a, c, t, g, unknown or other
  modified_base (539)..(539): a, c, t, g, unknown or other
  modified_base (565)..(565): a, c, t, g, unknown or other
  modified_base (571)..(571): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcagcctctgggtcagcatcagtaacgactacatgaccgtgggccccnccaggcctccgagggggaagggctgggaggtgggtctcgagttattagaaacngatggacactacattaaattattcgtagaccgttccggtaggaacggggtcccggttaccaccccttcgtacccaggaacacctactttacccaaactaactattcttgtaatcttacaacctatcgactaacaagtctgacgagtaccgaccgactaccggcctaaccgtaattattggtcncgtcacagttgacctgctcaagtcgngggccngggaaccg

SEQ ID NO: 366174 - DNA, 635 bp, Homo sapiens
  misc_feature: GZ8MTXP01BR7DJ.10.38.D05.1.454.CMB.2.raw
  modified_base (426)..(426): a, c, t, g, unknown or other
  modified_base (583)..(583): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaggtgtccactgtgaggttcaacgtggtggagacgtgggaggaggctggatccagccgtgggggtccctgagactctcctgtgcacgtcctcgtgggttcagcatcaagtaacgactacatcgaccgtcgggccccgccaggcctccggagggggaaggggctgggaggtgggtctcgtagttatagaaacagacgtggcaactacattaattactctgtacgtccggtagaacgggtcccggttcacccctntaccgaagtacgacctaacctttaaccaaaaccgtaaactacgttaccttagtacttacctttacaacctattacggacctaaaccaaaggttcctaggaagacgtaacccgacggaaacctacccggcctaaaccgttaatttagctacgcccganaccattcgacttaacgcctaactaagttcggcgggtccgaaggggtaacccg

SEQ ID NO: 366175 - DNA, 549 bp, Homo sapiens
  misc_feature: GZ8MTXP01DAOXR.10.38.D05.1.454.CMB.2.raw
  modified_base (354)..(354): a, c, t, g, unknown or other
  modified_base (403)..(403): a, c, t, g, unknown or other
  modified_base (417)..(417): a, c, t, g, unknown or other
  modified_base (424)..(424): a, c, t, g, unknown or other
  modified_base (435)..(435): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatgaccgtgggccccgccaggcctccgaggggaggggctgggagtgggtctcgtagttatagaaacngatggcatacataattatctgactccgtagacgggcgtcaccctctcanagcacttaccaaanacatctntatcttacacntgcaacaatctgagagtacgacgaccacggcctaacctaattattcggtagccgtacgcttaacgttgaaccttaacgctcaagttcgttacggggaaccgaaggggtaacccg

SEQ ID NO: 366176 - DNA, 615 bp, Homo sapiens
  misc_feature: GZ8MTXP01DMOY9.10.38.D05.1.454.CMB.2.raw
  modified_base (219)..(219): a, c, t, g, unknown or other
  modified_base (359)..(359): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgagggaaggggctgggagtgggtctcagttatgaaacngatggcactacatattattctgactccgtggaacgggccggttcaccctctccagacgacacttaccaaacaacatcttgtatcttcacatgacacaatctgagagtcgacgacacggccaccctattatgtgcgcgacntgacctacgctcaattcggtacggggccagggacgcccgaggtaccacccgtcctccccgacgccctacccaaccgaacgggacccacgttccgggggtcccttcccccgtcggcccgcccctcggccctacgacggaccgccacccgtcccgaacggaacgcgaacgccggttccgggcccgtcggggccgttcggttcccgttgggtacccgtaaacgggtacccttacccttacccctaacgttaacctaacg

SEQ ID NO: 366177 - DNA, 691 bp, Homo sapiens
  misc_feature: GZ8MTXP01EPOWM.10.38.D05.1.454.CMB.2.raw
  modified_base (174)..(174): a, c, t, g, unknown or other
  modified_base (205)..(205): a, c, t, g, unknown or other
  modified_base (218)..(218): a, c, t, g, unknown or other
  modified_base (266)..(266): a, c, t, g, unknown or other
  modified_base (271)..(271): a, c, t, g, unknown or other
  modified_base (283)..(283): a, c, t, g, unknown or other
  modified_base (302)..(302): a, c, t, g, unknown or other
  modified_base (360)..(360): a, c, t, g, unknown or other
tcagcatagtagtgcacgaccggtgctcgatttagtatctgatagttgggtttgggctgtgaggttcaactggtggagactggaggaggctggatccagcctgggggggtccctgagactctcctgtgcagcctctgggttcagcatcagtaacgactacatgacctgggcccncaggctccgagggagggctggagtgggtctnagttatagaaacngatggcactacattattattctgactcggtgacgggccgttcacctcncaganacacttccaaanacattcttgtatcttcacntgacaacaatctgagacgtcgacgacacggcctaaccttattatgtcgccgaacgacngtcgaactacgcttacgaaagtttcgggtacgggggaccgaggggacgacccgaggtcccacccggtccctaccccgacgtcccctacccgaacccgaacgggcccctacgttcccgggggttcccctttcccccggtcggccccgtccccgttcgcccgtaccggacgggtaccgacccgtacccgtacccggaacggaaccgcccgaaaccggtccgggcccggggtccccggttcgggggcccgttccgggttccccgttaaggggtaacccgtaaaccggggttaacccttaaccccggttaccccttaaccgttaacgtttaaccg

SEQ ID NO: 366178 - DNA, 579 bp, Homo sapiens
  misc_feature: GZ8MTXP01BKHVD.10.38.D05.1.454.CMB.2.raw
  modified_base (310)..(310): a, c, t, g, unknown or other
  modified_base (452)..(452): a, c, t, g, unknown or other
  modified_base (469)..(469): a, c, t, g, unknown or other
  modified_base (483)..(483): a, c, t, g, unknown or other
  modified_base (509)..(509): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtccctgagactctcctgtgcagcctctgggttcagcatcagtaacgactacatgaccgtgggccccgccgaggcnccgagggggaaggggcgtgggagtgggtctcgagttatgaaacagatggacactacattaacttattctgtacgtccgtaggtaacggggccggttccacccgttctaccagacgaacctaccttaccaaacaactatcttntactcttaccaacagtnacaacaatctgagngtaccgacgtaccacggcccaacttnttacttgtcgcgacgacagttcgaccttaacgcctctaaacgttcgacggggggtccaacgggggaaccg

SEQ ID NO: 366179 - DNA, 668 bp, Homo sapiens
  misc_feature: GZ8MTXP01C4I8U.10.38.D05.1.454.CMB.2.raw
  modified_base (364)..(364): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagcctcgtgggttcagcatcagtaacgactaacatcgacccgtgggccccgccaggctccgagggggaacggggcgtgggaggtgggtctcgtagtttatagaaacngatggactactaactattaattacttcgtagtaccgttccggtagggaaccggggtcccgttaccacccctcgtacacgacgacctaccttaccaaactaactattccttagtacttccttacgaacctatcgaccaaactaactaccgtgaagtacggtacccgaacggaacccgtaacccgggtaccctaaccctttaaagtttcgttcggttacgaccgtacgaaccgttattccggttaacccttaacggtacctaacgttaacggtcgggttaccgggggtccgaacggggtaaccccg

SEQ ID NO: 366180 - DNA, 656 bp, Homo sapiens
  misc_feature: GZ8MTXP01BFS2R.10.38.D05.1.454.CMB.2.raw
  modified_base (368)..(368): a, c, t, g, unknown or other
  modified_base (483)..(483): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccagccgtgggggtccctgagactctctgtgcagcctcgtgggttcagcatcaagtaacgactacatcgaccgtcgggccccgcgacggcctccggagggggaagggggcgtgggaggtcgggtctacgtagtttattagaaacnggtactggacactaacaattaatttacttctagacctcggtggaaccgggtccggttacacccctctaccaggtacactaccttaccaaactactatccttagacttcttacacncgtgaccataactcgtagacgacgtaccggaacgacccgtacccggtaccctaacccgtttaagtttaacgtttgggtaccgccggtaaacgaacacggtttaccggacccttaaccggtcctaaccgtaaggttttccccgggagggggaacccttaacggggggaaccccc

SEQ ID NO: 366181 - DNA, 532 bp, Homo sapiens
  misc_feature: GZ8MTXP01AVYKD.10.38.D05.1.454.CMB.2.raw
  modified_base (349)..(349): a, c, t, g, unknown or other
  modified_base (397)..(397): a, c, t, g, unknown or other
  modified_base (442)..(442): a, c, t, g, unknown or other
  modified_base (480)..(480): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaggggctgggagtgggtctcagttatgaaacngatggcactacataattatctgactcgtgaacgggccgttcacccgtntccagagaccacttcccaaacacatcttagtactcttcacaggtncaacaatctgagacgtcgacaccacggcccactaattnttgtgcgcgacagttcgactaacgctcaagttcgagggggcccaaggggccc

SEQ ID NO: 366182 - DNA, 639 bp, Homo sapiens
  misc_feature: GZ8MTXP01CHTDX.10.38.D05.1.454.CMB.2.raw
  modified_base (371)..(371): a, c, t, g, unknown or other
  modified_base (570)..(570): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagctctcctgtgcagcctcgtgggttcagcatcaagtaacgactacagtcgacccgtcgggccccgcgacggcctccggaagggggaacggggcgtagggaggttgggtctcgtagttatagaaacngactggacacgtactattaaatttacttcgagtaccgtcgggttacgggaacgggtcccggtttaccaccccttcgtaccaaggaccgtacctaaccttaccaaactaactattccttagttactcttacactatcgacacgtaattcgagagacgtaccgaacgtacccgaccgtacctaccttaagttagttggtcnccggactacagttcgaaccttaaccgcttaaccgaaggtttccgggacggggccgaaacggggtccccg

SEQ ID NO: 366183 - DNA, 730 bp, Homo sapiens
  misc_feature: GZ8MTXP01ER6KU.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtgggaggaggctggatccgacggccgtgggggtcctgacgactctcctgtcgcacgcctcgtgggtcagcatcaagtaacgactacagtcgaccgtcgggccccacgacggccgtaccgggaaggggggaacgggggtcggtaggggtaggtcgggggttccttacgtaaggtttaacttaggaaaacgaggtacgtacggactaactaacctaatttaaaactttacttcgtacgtaccgttccgggtacgggtaaccggggtccccggttaccaccccttctacccgagaacgtaacctaccttaaaccaaactaacttacttcttatacttcttacactaacgtcgaccaaactaactcgtacgaaggacgtaccgaaaccgaaccgtacccggaccctaaacgtttaatttcgttcggggtcacccggaccgtaaacttacggttcgaacccgtttaaccgacttaacgtaacggttcccggggacggggtaaccccggaaggggtaaccccg

SEQ ID NO: 366184 - DNA, 664 bp, Homo sapiens
  misc_feature: GZ8MTXP01CMAPO.10.38.D05.1.454.CMB.2.raw
  modified_base (219)..(219): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgaggggaaggggctggagtgggtctcagttatgaaacngatggcactacatattattctgactccggtgaacgggccgttcaccctctaccagacgacacttaccaacaacatcttgtactcttcactatgacacatctgaagagtcgacgacgaccggcctaccccttattagtgtcgccgacgactaagtcgacgtaccgctactaacgttcggcggggaccgaggggaccgcccgtacggtccacccgtcctccccgacgccctaccgaccgaccggccctacgtcccggggttcccttccccgtcggacccgtcccgtcgccgtacccgacggaccgtcccacccgtccggagaaccgccgaccggtaccggcccggggtccccgtcgggggcccgttccgggttaccccgttaaccggggtacccgtaaaccgggtaccccttaacccggtttaccccctaacgttaacccgttaacg

SEQ ID NO: 366185 - DNA, 592 bp, Homo sapiens
  misc_feature: GZ8MTXP01ENCXX.10.38.D05.1.454.CMB.2.raw
  modified_base (275)..(275): a, c, t, g, unknown or other
  modified_base (357)..(357): a, c, t, g, unknown or other
  modified_base (459)..(459): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcancaagtaacgactacatcgacccgtgggccccgccaggctccgaggggaagggcgtgggagtgggtctcgagttatagaaacngaatggacactaactataattattctgtaacgtccgtaggaacggggtcccggtacaccccttctaccaaggacacctaccttaccaaaacactagtcttanactcttacaacgtatgaccaacaatcagagagtaccgactacaccggccctaactaattacgttggcgcgacgaacagttcggaacctaacgctaacgtaagttccggacgggggaaccaagggggtaacccc

SEQ ID NO: 366186 - DNA, 688 bp, Homo sapiens
  misc_feature: GZ8MTXP01C3HC4.10.38.D05.1.454.CMB.2.raw
  modified_base (220)..(220): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttattgaaacngatggcactacatattatctgactccgtgaacgggccgttcaccctctccagagacacttccaaacaactatcttgtatctcacatcgacaacatctgaagcgtacgaccgacacggcctaacctattacgtgtgcgaacgacaatgacctacgctacgaactttcggcggggaccaggggaccacccgacggtccctaacccggtccctacccccgacgtcccctacccgaaccgaacgggtacccctaacggttcccggggttccccttccccccggtcgccccgtccccgtacgcccgttacccgaacgggacgaccccgtaccgtacccggaagaaccgccgttaaacggaccggcccggggtccccgtgggggttcccttccggggttacccgttaagggggtaaccctaaacggggtaccccttaaacccgtttcccccgtaaacgtttaacccttaacggg

SEQ ID NO: 366187 - DNA, 574 bp, Homo sapiens
  misc_feature: GZ8MTXP01A0VPK.10.38.D05.1.454.CMB.2.raw
  modified_base (275)..(275): a, c, t, g, unknown or other
  modified_base (352)..(352): a, c, t, g, unknown or other
  modified_base (485)..(485): a, c, t, g, unknown or other
  modified_base (489)..(489): a, c, t, g, unknown or other
  modified_base (521)..(521): a, c, t, g, unknown or other
tcagcatagtagtgcacgaccggtgctcgatttagtatctgatagttgggtttggggggagaggagccaagcactgggattccgaggtgtttccattcggtgatcagcactgaacacagaggactcaccatggagttttggctgagcttgggttttccttgttgctatttacaaaaggtgtccactgtgaggttcaactggtggagactggaggaggctggatccagccgtgggggtccctgagactctcctgtgcagcctcgtgggttcagcancagtaacgactacatgaccgtgggccccgcaggctccgaggggagggctgggagtgggtctcgagttactagaaacngatggctactacattaaattacttctgacctccgggtaggaacggggtcccggttacacccctctacccgaggacacctaaccttaccaaactaactattccgttatactcttacgactagtcacacaagtcngganacgtcgacgacaccgccacttaattacgttgngcgacacacttcgactaacgctaacgaacttcggacggggcccaaggggcccg

SEQ ID NO: 366188 - DNA, 563 bp, Homo sapiens
  misc_feature: GZ8MTXP01BWXDX.10.38.D05.1.454.CMB.2.raw
  modified_base (511)..(511): a, c, t, g, unknown or other
  modified_base (540)..(540): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctggggttcagcatcagtaacgactacatgacctgggccccgccaggctccgagggggaggggctgggagtgggtctcgagttatagaaacagatggcactacataattatctgactccgtgaacgggccgtcaccctctccaagcgacacttacccaaactactatcttgtatccttacaccatgccaacaatcgtgacgtcgtaccgacgaccaccgggcctaccttaattacgttggtacgcgcgacncttcggacctaacggctccgaagttccgngggggtcccaagggggtaacccg

SEQ ID NO: 366189 - DNA, 765 bp, Homo sapiens
  misc_feature: GZ8MTXP01AZYWQ.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgaggccgtgggggtccctgagactctcctgtgcagcctcgtgggtcagcatcgaagtaaccgactacagtcggacccgtcgggccccgccgagggccgtaccgggaagggggaacgggggcgttagggggtaggttcgggggttaccttacggtaaggttttaagttaacggaaaacgaggtaagttcgggactaaccgtaactaatttaaactttactttcgtacggtacccgtcccgggttacgggtaaccggggtcccggttaccctaccccttccgtaccgaaggtaaccgaccctaacctttacccaaaactaacccttatttacctttacgtaactttcccttacaacctagtacgactaaccgtaactcgtaccggagtacgtaccggaaccgaccgtacccggaccttaaccttaatttacgttgggtaccgccgaacggtaacttacgtttcgaaacccgtttaaccggaccttaacgttaaaccggtttccggggacgggggtaaccccggttaagggggtaacccccgg

SEQ ID NO: 366190 - DNA, 648 bp, Homo sapiens
  misc_feature: GZ8MTXP01CZ1G9.10.38.D05.1.454.CMB.2.raw
  modified_base (585)..(585): a, c, t, g, unknown or other
tcagcatagtagtgcacgaccggtgctcgatttagtatctgataggttgggtttggggggagaggagcccagcactgggattccgaggtgtttccattcggtgatcagcactgaacacagaggactcaccatggagttttggctgagcttgggttttccttgttgcttatttcaaaaggtgtccactgtgaggttcaacgtggtggagacgtgggaggaggctggatccgagccgtgggggtccctgagactctcctgtgcagcctgtgggttcagcatcaagtaacgactacagtcgaccgtgggccccgccgaggcctccgagggggaaggggctagggaggtgggtctcgtagttagttagaaacgtagatgggactacgtaactattaaatttacttcgtagtaccgtaccgggtagggaaccggggtcccggttaccaccccttacgtacccgaaggaactaccctaaccttacccaaaactaactcttaccgttataactccttaccgactagttcgacctaaacaacgttcgagaacgtacgtaacccgacgaaccgacccggcctaactaatttagnggtcgccgtagacagttcaacgtcgctaacgttaattcggacggggaaccgaagggtaacccg

SEQ ID NO: 366191 - DNA, 667 bp, Homo sapiens
  misc_feature: GZ8MTXP01BNHAQ.10.38.D05.1.454.CMB.2.raw
  modified_base (372)..(372): a, c, t, g, unknown or other
  modified_base (470)..(470): a, c, t, g, unknown or other
  modified_base (562)..(562): a, c, t, g, unknown or other
  modified_base (596)..(596): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtggaggaggctggatccgagccgtgggggtccctgacgactctcctgtcgcacgtcctcgtgggtcagcatcagtaacgactacacgtcgaccgtcggcccgcgacggcctaccggagggggacggggcgtagggaggtgggtactcgtagttatagaaacngagtggacatactataattacttctgtaccgtccggtacgggaacgggtcccggtacctacccgtctacgaagtacacctaacttaccaaactaactnttcttagtacttcttaacactagtcaactaacctaaagttccgttaggacgtaacggtaccgaacgaaccgtacccggtacctaaaccgttnttttaaacgttcggtacgttcccgaacggtaacncgggttacaacccgttaacgtccttaacgtaacgggtttcccggaacgggggtcccaaacggggggtcccg

SEQ ID NO: 366192 - DNA, 638 bp, Homo sapiens
  misc_feature: GZ8MTXP01E2TF5.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcgacccgtcgggccccgccgacgggcctccggaagggggaacgggggcgtgggaggtgggtctcgtagtttatagaaacagactggactaactactattaaacttacttcgtagtaccgttccgggtaggaacggggtcccggttccaccctctaccgagacgacctaccttaccaaacaactattcttagtacttcttacaacacttcgaccaactaactcgtagacgacgtaccgaccgtaaccaccggtccctaacttaactttagttcggtcgaccgcgaacacgttcgaaccttaactcctaactaacgtttccggacggggtaaccgaacggggtaaccccg

SEQ ID NO: 366193 - DNA, 533 bp, Homo sapiens
  misc_feature: GZ8MTXP01D9ODK.10.38.D05.1.454.CMB.2.raw
  modified_base (299)..(299): a, c, t, g, unknown or other
  modified_base (342)..(342): a, c, t, g, unknown or other
  modified_base (349)..(349): a, c, t, g, unknown or other
  modified_base (354)..(354): a, c, t, g, unknown or other
  modified_base (364)..(364): a, c, t, g, unknown or other
  modified_base (426)..(426): a, c, t, g, unknown or other
  modified_base (441)..(441): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggttttcctgtagctattcaaaaggtgtccactgtgaggttcaactggtggagactggaggaggctggatccagccgtggggggtccctgagactctcctgtgcagcctcgtgggtcagcatcagtaacgactacatgacctgggcccncaggctcgaggggaggctggagtgggtctcagttatagaaacngatgganactanataattatcngactccgtgaacgggtccgttcacccttcaccagacgaccacttacccaaacactatcttanactcttacacaggtnacacaactctagagagacgacgacacgaccacctaattattgtgcgcgacagttcactaacgtctctacgtcgttcgggtcggcggaaccgg

SEQ ID NO: 366194 - DNA, 529 bp, Homo sapiens
  misc_feature: GZ8MTXP01ALCSM.10.38.D05.1.454.CMB.2.raw
  modified_base (411)..(411): a, c, t, g, unknown or other
  modified_base (491)..(491): a, c, t, g, unknown or other
  modified_base (499)..(499): a, c, t, g, unknown or other
  modified_base (503)..(503): a, c, t, g, unknown or other
  modified_base (509)..(509): a, c, t, g, unknown or other
  modified_base (517)..(517): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtcccctgagactctcctgtgcagcctcgtgggttcagcatcagtaacgactacatcgacctcgggccccgccaggcctccgaggggaagggggctgggagtgggtctcgagttatagaaacagatggacactacattaattattcgtgactccgtagaacgggtcccgttcaccctntccagacgacaccttcaacaacactcttgacttcttcacatcgacacaatctgagatcgacgacacggcctaactaattnttgtgcgngacnttgacngctcattncggggcaaggcg

SEQ ID NO: 366195 - DNA, 654 bp, Homo sapiens
  misc_feature: GZ8MTXP01EXJZX.10.38.D05.1.454.CMB.2.raw
  modified_base (281)..(281): a, c, t, g, unknown or other
  modified_base (579)..(579): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggtttttccttgttgcttatttacaaaaggtgtccactgtgaggttcaacgtggtggagacgtggaggaggctggatccgagccggtcgggggtcctgagactctctgtgcacgcctgtggtcagcancaagtaacgactacagtcgaccgtcgggccccgcgacggcctacggagggggaacgggcgtgggaggtgggtctacgtagttatagaaacagtacgtcggactaactactaattaaattattcgtacgtacgtacccggtacgggtaaaccggggtcccgttacctaaccccttctaacccgaagtaacccgtacctaacccttaaccaaaactactacttcgttatactcttacgaactgtacgactaacaagtctagacgtacgtaccgaaccgacaccggtacctaacttaattnttggcgccgacgtaacttacgttcgaaaccttcgacttaacgtaacgttcggggacgggaaccgaaggggaaccc

SEQ ID NO: 366196 - DNA, 728 bp, Homo sapiens
  misc_feature: GZ8MTXP01C1NIM.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgcttatttacaaaaggtgtccactgtgaggttcaacgtggtggagacgtggaggaggctggatccgaggccggtgggggtccctgacgactctcctgtcgcacgcctgtggttcagcatcaagtaacgactacagtcgacccgtcgggccccgccgagggcctccggaagggggaacgggggtcgtaggggaggttcggggttctacgtaagtttaagttacgaaacgtagacgttcggactaactaactaatttaaactttactttcgtacgtacccgttccgggtacgggaaccggggtcccggttccacccctactaccgaagacgaacctaccttaacccaaataactattctttacgtacttcttacaacctagttcgaacctaactaacgttacgtacggaagaccggttaaccggaaccgtaaacccgtacccggtacccctaaccgtttaagttttaacgttcggtcgaccgaacgtacttaaacgttcgttaaccctaaccggtcttaacgtaaacggttccggacgggggaacccttaacggggtaaccccg

SEQ ID NO: 366197 - DNA, 625 bp, Homo sapiens
  misc_feature: GZ8MTXP01BN23U.10.38.D05.1.454.CMB.2.raw
  modified_base (253)..(253): a, c, t, g, unknown or other
  modified_base (349)..(349): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtgcttataactntgtctctggtacagcaccaccagacaaacgccccaattccttgtttgagtcagtagcgcctgaggctcctgtactcggttctctcgcctacagtcnggaacaacgcggcctccctcgacctctcgtgggcctcgagctggaggatggacgtcgtagtacttactacgtgcaacggcgacttaattacgttaccgaccgggacccctaaaggtaggggtttcggtttacgggcggggtaccgggtaaacgttaagggggtccgtacccggttcggttcggggacgaaccggcccgttaacgggttcccttccccggtcccccgttcgggtaacctaccttcccgttcccggttcccccaaccccgtttccccg

SEQ ID NO: 366198 - DNA, 717 bp, Homo sapiens
  misc_feature: GZ8MTXP01BV91E.10.38.D05.1.454.CMB.2.raw
  modified_base (280)..(280): a, c, t, g, unknown or other
  modified_base (531)..(531): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggtagtttggctgagtcttgggttttccttgttgcttatttacaaaggtgtccactgtgaggttcaacgtggtggagacgtggaggaggctggatccgaggccggtcgggggtcctgacgctctcctgtcgcacgcctgtggtcagcanacaagtaacactacagtcgaccgtcgggccccgccgacggaccgtacgggaagggggaacgggggcgtaggggtagggttcggggttaccttacggtaaggtttaagtaacggaaaacgaggtaagtcggactaacctaactaatttaaactttacgtttcgtacggtaacccgttcccgggtacggggtaaccggggttcccggttaccctacccctctacgaagacacctaccgtacccaaaactactnttcttagtaactcttaccaactacggtactacaaactaactcgtaagacggtacgtaacccgaacgtaccgaacccggtcctaaaccgtttgttaaccgtttggccggaccgtacgtaacttacgttcgttaaccgtcgtccttaacgtacggttcgggaccgggggcccgttaagggggtccccg

SEQ ID NO: 366199 - DNA, 725 bp, Homo sapiens
  misc_feature: GZ8MTXP01D4OCM.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttcaaaaggtgtccactgtgaggttcaactggtggagactgggaggaggctggatccgagccgtgggggtcctgagctctcctgtgcagcctgtgggtcagcatcagtaacgactacagtcgacccgtcgggccccgaccgaggccgtaccggagggggaagggtcgtagggacgttgggtactacgtagtttagtaacgaaacacgtagccggactaactactattaaactttacttccgtgtaacccgttcggtacgggtaaaccggggtccccggttaccctaaccccttccgtacgaacggtaacctaaccttaaccctaaccctaaaactaacttactttacgtttacttacttcccttaacaaccgtaattcggaacctaaacgtaactttcgtaacggacgtaacggttaaccggaacccgacctaacccggtccctaacgtttaaacgtttgttacggtacgttccgaaccggtacttacgttccgttaccgtaaccgtactaaccgttaacgttccgggaccgggggaaccgttaacgggccccgg

SEQ ID NO: 366200 - DNA, 662 bp, Homo sapiens
  misc_feature: GZ8MTXP01DEJFA.10.38.D05.1.454.CMB.2.raw
  modified_base (346)..(346): a, c, t, g, unknown or other
  modified_base (463)..(463): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgagccgtgggggtccctgagactctcctgtgcagcctcgtgggtcagcatcaagtaacgactacatcgaccgtcggccccgcgaggcctcggaagggggaacggggctgggaggtgggtcncgtagttatagaaacagtactggacacgtaactattaaattattcgtagtaccgtaccggtaggaaccgggtcccgttaccacccttctacagacgactaccttaccaaataacgtnttcttagtactcttacaacgtagtacactaaactaatccgtaggaacgtcggtaaccgaaccgtaaccgaaccgggtaccctaaactttaagttacgtttcggcgaccgtaccggtacttaagttccggttaaacctaaccggtacttaaccgtaaacggtttccggggacgggggtaacccgaacgggggtaaccccg

SEQ ID NO: 366201 - DNA, 653 bp, Homo sapiens
  misc_feature: GZ8MTXP01CCLZ8.10.38.D05.1.454.CMB.2.raw
  modified_base (369)..(369): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgaggccgtgggggtccctgagactctcctgtgcagcctcgtgggttcagcatcaagtaacgactacatcgacccgtcgggccccgccgagggcctaccggagggggaaggggcgtgggaggtgggtctcgtagttatagaaacngatggactactacattaattacttcgtgtaccgtccggtagggaaccggggtcccggttaccaccctcctcagacgacctaccttaccaaactactattcttagtacttcttacacgtactcgacctaaacgtacttacgtacggaagtacgaccggaaccgtaaccgaccggtaccctaaccgttaatttacgttcgtcggaccgtaacgacttaacgttcggaaccttcggaccttaacgtaacggttcgggttacggggaacccgttaagggggaaccccg

SEQ ID NO: 366202 - DNA, 735 bp, Homo sapiens
  misc_feature: GZ8MTXP01C1OYK.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtggaggaggctggactccgaggtccgtgggggtccctgagtattctcctgtgcacgcctcgtgggttcagcatcgagtaaacgactacatcgaccgtcgggccccgccgacggccgtccggaaggggggaacgggggcgtagggggtacggttcgggggttctaccgtaaggtttaacgttacgaaaacgtaggaacgttacgggaccttaactaaacctaatttaaacttttaacgttccgttacgtaaacccgttccgggtacgggtaaaccgggggttccccggttacccaccccgttctacccgaaggttaaccgaacctaacccttacccaaaactaactcttaccgtttgtaaacttctttaaccacgtaacttcgaacctaaactaacgtctaagggacgtacgtaccggaacctaccgaccggacctaacgttaattgttcgtgcggtaaccaacttattacgaccttaaccgtctaacgtaacggttcggcgggaacccgttaacggaacccgg

SEQ ID NO: 366203 - DNA, 630 bp, Homo sapiens
  misc_feature: GZ8MTXP01CBGMF.10.38.D05.1.454.CMB.2.raw
  modified_base (305)..(305): a, c, t, g, unknown or other
  modified_base (356)..(356): a, c, t, g, unknown or other
  modified_base (605)..(605): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagtcctcgtgggttcagcatcagtaacgactacatcgaccgtgggcccnccaggctccgagggggaaggggctgggagtgggtctcgagttatagaaacngactggacactacattaatttattctagaccttccgggtaggaacggggtcccggttacaccccgtctaccaaggaacgacctaaccttacccaaaactaactaacttccttagtaacttcttacaacctattcgaccaaacctaagttccgtagaagtagtaccgaacgacctaccggacctaaccgtaatttacgttgtacgcgaccgaacttagttcgaactaaccggactcgtaacgtttccggngggggtaaccccaagggggtaaccc

SEQ ID NO: 366204 - DNA, 764 bp, Homo sapiens
  misc_feature: GZ8MTXP01BX7EZ.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgcttatttacaaaaggtgtccactgtgaggttcaacgtggtggagacgtggaggaggctggactccgaggccggtgggggtccctgacgactctccgtgtgcacgtcctcgtgggttcagcatcaagtaaccgactacatcggacccgtcgggcccccgccgacgggccgtccggaagggggaacgggggcgtggggtaggtcggggttcctacgtagtttaattaggaaaacgaggtacgtcggactaactaactattaaactttacttcgtacggtacccgttacccgggttacggggtaaacccgggggttccccgggttaccctaacccccgttcgtacccgaaacggtaaccggaacccttaaccctttaaccccaaaaacctaacttactttacctttagttaaccttccttaacaacctagggttccaacctaactaacgttccgtaggaacggtaacggtacccggaaccgaaccgtacccggtaccctaaccgtttaatttaacgttcggtcgcgtaccgtaacttacgcgttaacctcggtctaacgtaacgttcgggttacggggaacccggaacggggtaaccccg

SEQ ID NO: 366205 - DNA, 564 bp, Homo sapiens
  misc_feature: GZ8MTXP01AX39M.10.38.D05.1.454.CMB.2.raw
  modified_base (220)..(220): a, c, t, g, unknown or other
  modified_base (322)..(322): a, c, t, g, unknown or other
  modified_base (348)..(348): a, c, t, g, unknown or other
  modified_base (354)..(354): a, c, t, g, unknown or other
  modified_base (364)..(364): a, c, t, g, unknown or other
  modified_base (371)..(371): a, c, t, g, unknown or other
  modified_base (381)..(381): a, c, t, g, unknown or other
  modified_base (474)..(474): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgaggggaaggggctggagtgggtctcagttatagaaacngatggcactacatattattctgactccgtgaacgggccgttcaccctctccagagacacttccaaacacatcttgtatcttcacatgcaacaatctagaagngtcgacgacacggccacctattatgncgcacntgactcgctnaattcgngggcagggcnccgaggtccacccgtcctccccacgccctaccaccgaacgggccctacgtccggggtcccttccccgtcggcccgccctcgcctccgacggcnccaccgtcgagaacgcacgacggcccggccgtgggccttcggccgtaacgggcaaacgggtaccctaccgttacccaacgttaacctaag

SEQ ID NO: 366206 - DNA, 745 bp, Homo sapiens
  misc_feature: GZ8MTXP01CP4PG.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggtttttccttgttgcttatttacaaaaggtgtccactgtgaggttcaacgtggtggagacgtggaggaggctggacgtccgggcgtcggggggtccctggacgactctctgtgcagcctcgtgggtcagcatcaagtaacgactacatcgaccgtcgggccccgcgaggcctaccggaagggggaaggggtcgtagggacggttggggtcctacgtaggtttagtaacgaaaacgtgtagtccggacctaaactactaatttactttaaactttccgtggtaacccgtttaccgggtagggtaaaccggggtccccgttacccaccccgttccgtacccgaaaggtaaacctaaccctaaccttaaccccaaaactaacgttatttcctttagttaacttacccttaacgaactaacgttcggaaccaaacgttaatccgtaagacgcgtacgaaaccgacctacccgggaccttaaactttgttaactcgggttacgaccgcgtaaactgttaccggttaaccttacggttccctaaacgttaacggttccggacggggggacccctaacgggggttaaccccgtccccgg

SEQ ID NO: 366207 - DNA, 644 bp, Homo sapiens
  misc_feature: GZ8MTXP01DT43O.10.38.D05.1.454.CMB.2.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagtcttgggttttccttgttgcttatttacaaaaggtgtccactgtgaggttcaactgggtggagacgtgggaggaggctggatccgagccgtgggggtccctgagactctcctgtgcacgtcctcgtgggtcagcatcagtaacgactacatcgaccgtcgggcccgccgacggcctccggagggggaacgggggcgtgggaggtgggtctacgtagtttatagaaacagtactggacactacattaatttacttcgtacgtaccgttaccggtacgggtaaccggggtcccggttaccaaccccgttctaccgaagacgtaacctaaccttacccaaaactactattccgttatactcttacactagtcacaactactcgtagagacgtacgaaccgtacaccggtacctacgttaatttacgttgtacgcgacgtacttacgttcgttaacctcgactaacgtaacgttcgggaccggggccgaagggggtaaccc

SEQ ID NO: 366208 - DNA, 592 bp, Homo sapiens
  misc_feature: GZ8MTXP01CNOW9.10.38.D05.1.454.CMB.2.raw
  modified_base (544)..(544): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacccgtgggccccgccacggctccgagggggaacgggggctgggaggtgggtctacgtagttattagaaacagactggacactatattaattacttctgtactccggtgaacggggtcccgttacaccccttctccagacgacctacttacccaaactaacctattacctttagtacttcctacaacctagttcgacaactaactactagacgcgtacgaccgacaccggcctaccttaatattggtcacgccganagttcacctaacgctaactaacgttcgggcggggccgaaggggtcccg

SEQ ID NO: 366209 - DNA, 753 bp, Homo sapiens
  misc_feature: GZ8MTXP01CT9R4.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgaggccgtggggggtccctgagactctcctgtgcacgcctcgtgggtcagcatcagtaacgactacatcgacctcgggccccgccgaggcctaccggagggggaacgggggcgtagggaggttcggggtctcgtagtttattacggaaacgtagacttcgggacctacttaaactaattaaactttacttcgtaggtaacccgttcccgggtagggtaaccgggggtccccgggtttacccaaacccccgttcgttacccgaacgggtaacgtaacccttaaacccttacccaaaaacctaaaccttacttacctttagttaacttaccttaccaaacctagttcgaacctaaccctaaagttccgacggtaaggaaccgttaccggaaacccgtaaaccgacccgggtaccccttaaacccgtttaatttaccgtttagggtcggacccggtacggaacttacgttcggttaaaccttaacggccttaacgtaacgttcgggacgggggtcccaagggggtaaccccg

SEQ ID NO: 366210 - DNA, 662 bp, Homo sapiens
  misc_feature: GZ8MTXP01BVXDZ.10.38.D05.1.454.CMB.2.raw
  modified_base (279)..(279): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtgggggtccctgagactctcctgtgcacgtcctcgtgggttcagcancaagtaacgactacagtcgaccgtcgggccccgcgacggccgtccggaagggggaacgggggcgtggggtaggttcgggttcttacgtaaggtttaagttaggaaaacgaggtacgtcgggactaacgtaactatttaaattacttcgtcgtaccgttccgggtacggtaccggggtcccgttaccacccgttacaccgaagacgacctaccttaccaaaactactattccgttatacttactacactatcgacaactaagttcgagacgacggtaccgacgtaccacgccctaacttaagttagttgtcgcgacgaattcgttcgacctaaccgtctaacgttaacgtcggggttaccgggaacccgaagggggtaaccccg

SEQ ID NO: 366211 - DNA, 597 bp, Homo sapiens
  misc_feature: GZ8MTXP01EMMUQ.10.38.D05.1.454.CMB.2.raw
  modified_base (316)..(316): a, c, t, g, unknown or other
  modified_base (454)..(454): a, c, t, g, unknown or other
  modified_base (521)..(521): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagtttggctgagctgggttttccttgttgctatttcaaaaggtgtccactgtgaggttcaactggtggagacgtggaggaggctggatccgagccgtgggggtcctgagactctcctgtgcagcctcgtgggtcagcatcaagtaacgactacagtcgaccgtcgggccccgccgagggccnccggaagggggagggggctgggggagtggggttctcgagtttatagaaccgagactggacaactactattaaattattctagacctcggtaggaacggggtccgttcacccctctcgagacactactaccaaacactntccttagtactcttcacatcgacacatctgaacgcgtccgaactacccgaacggtcctaaaccgttntttaagttccgggcgaccgacgaacacgttcgaacctcgactaacgtacggtcgggccgggtaaccgaaggggccg

SEQ ID NO: 366212 - DNA, 702 bp, Homo sapiens
  misc_feature: GZ8MTXP01CTVQL.10.38.D05.1.454.CMB.2.raw
  modified_base (265)..(265): a, c, t, g, unknown or other
  modified_base (285)..(285): a, c, t, g, unknown or other
tcagcatagtagtgcacgaccggtgctcgatttagtatctgatagttgggtttgggctgtgaggttcaactggtggagactggaggaggctggatccagcctgggggggtccctgagactctcctgtgcagcctctgggttcagcatcagtaacgactacatgacctgggcccgccaggctccgagggaaggggctggagtgggtctcagttatagaaacagatggcactacatattatctgactcgtgaacggccgtcacctcncagacacactaccaacaacntcttatactcttcactatgacaacatctagagagtacgacgaacacggcctaccttattagtgtcgcgacgaactgtcgaacctacgcctacgaacgttcggcggggaccaggggacccgacccgtaggtcccaaccccggtcctacccccgacgcccctaccgaaaccgaacggggcccctacgttccccggggttcccccttcccccggtcgggtcccctaccccgtcggcccttacccggacggaaccgtcccaaccccgtccccggaaggaaccgcccgaaacggacccgggttccccggggtccccgggtcggggacccgtttccgggaccccggttttcgggggaaaccccgtaaaccggggttaaccccttaccccggtttaaccccctaacccgtttaagttaacccgg

SEQ ID NO: 366213 - DNA, 648 bp, Homo sapiens
  misc_feature: GZ8MTXP01CNEZT.10.38.D05.1.454.CMB.2.raw
  modified_base (282)..(282): a, c, t, g, unknown or other
  modified_base (590)..(590): a, c, t, g, unknown or other
  modified_base (604)..(604): a, c, t, g, unknown or other
  modified_base (631)..(631): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtgggaggaggctggactccgagccgtgggggtccctgagactctctgtgcacgcctcgtggttcagcancaagtaacgactacagtcgacccgtcgggccccgccgagggccgtaccggagggggaacgggggctggggaggttgggtctacgtagttatagaaacgagaacgttcggactaacgtaactaattaaacgttttactttccgtacgtaacccgttccgggttacgggaaccgggggtccccggtttaccacccccgttctacccgaaggtacgaacctacccttaacccaaaactactattcttgtaacttctacactagtcactaacaatcgtagacgagtaccgacacgacccgactacttaattnttgtcgcggtaccnacgttgaacctcgctaactagttccgnggggccgaagggaaccc

SEQ ID NO: 366214 - DNA, 775 bp, Homo sapiens
  misc_feature: GZ8MTXP01EP5UB.10.38.D05.1.454.CMB.2.raw
  modified_base (264)..(264): a, c, t, g, unknown or other
  modified_base (286)..(286): a, c, t, g, unknown or other
  modified_base (321)..(321): a, c, t, g, unknown or other
  modified_base (518)..(518): a, c, t, g, unknown or other
  modified_base (525)..(525): a, c, t, g, unknown or other
  modified_base (533)..(533): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggtttttccttgttgcttatttacaaaaggtgtccactgtgaggttcaacgtggtggagacgtgggagggaggctggatccaggccggtgggggtccctgacgctctcctgtncagtcctcgtgggttcagcaancaagtaacgactaacagtcgacccgtcgggccccncgacggcctaccgggaagggggaagggggcgtggggtaggtcgggggtctacgtagtttaattaaggaaacagtacgtcggactaactaatatttaaacttattccgtagtaccgttacccgggttacgggaaaccggggttcccgttacccaaccccttcgacccgaaaggtaacacccttaaccttacccaaaanaaccttnttacgttntaaccttccttaacaactacttacgacctaaactaaacttcgtacgtaacgggtaacgtaccccgaaacgtaaccgacccccgggttaaaccttaacccttttaaagtttaacggtttcggcgggaccccgggtaaacgtaacttaacggttcccggttaaacccttaacccggttctttaaaccgtaaacgggtttccgggggttaccgggggtaacccggaacccggggggtaacccccg

SEQ ID NO: 366215 - DNA, 654 bp, Homo sapiens
  misc_feature: GZ8MTXP01C5KEH.10.38.D05.1.454.CMB.2.raw
  modified_base (341)..(341): a, c, t, g, unknown or other
  modified_base (535)..(535): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctctgggttcagcatcaagtaacgactacatcgaccgtcgggccccgccaggcctccgagggggaagggcgtggagtgggtcncgtagttatagaaacagactggacactacataatttatcgtgactccggtagaacgggtccgttcaccctctcagacgacctacttacccaaacaactattcttagtacttccttacaacctaagtcgaacctaactaaagtctaggacgttaacggaccggaaaccgaaccgaacccggcccctaaacctttntttaaacgttcgggttacacccgggtacgaaacccttagttcgggaaaccctttaacccgggccttaaccgtaaaggtttcccgggttaacggggggtcccccgaaggggggtaacccc

SEQ ID NO: 366216 - DNA, 586 bp, Homo sapiens
  misc_feature: GZ8MTXP01BIBPT.10.38.D05.1.454.CMB.2.raw
  modified_base (275)..(275): a, c, t, g, unknown or other
  modified_base (361)..(361): a, c, t, g, unknown or other
  modified_base (423)..(423): a, c, t, g, unknown or other
  modified_base (459)..(459): a, c, t, g, unknown or other
  modified_base (486)..(486): a, c, t, g, unknown or other
  modified_base (535)..(535): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagctctcctgtgcagcctcgtgggttcagcancaagtaacgactacatcgaccgtcgggccccgccaggcctccggagggggaagggggctgggagtgggtctcgagttatagaaacngactggacactacattaattattcgtgaccgtcggtaggaacggggtcccggttcacccctntaccagacgaaccaccttaccaaacactattcgttnacttcttacacatcgacaacatctganagtaccgaacaccgaccggcctaacttaattacgttggtcgcgacaacngttcgacctaacgctctaagttccggcgggggtcccaagggggtaaccccg

SEQ ID NO: 366217 - DNA, 711 bp, Homo sapiens
  misc_feature: GZ8MTXP01CGCUQ.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgcttatttacaaaaggtgtccactgtgaggttcaactgggtggagacgtgggaggaggcgtggatccgaggccgtgggggtccctgacgacctctcctgtgcacgtcctcgtgggttcagcatacaagtaacgactacatcgacccgtcgggccccgccgacgggcctccggaagggggaacggggctggggaggttcggggtctacgtagtttagtagaaacagacgtggactaacgtactattaaatttacttcgtacgaacccgttccgggtaggaaaccggggtccccggtttaccaccccgttactcccgaaggtaactacctaaccttaacccaaaactaacttaattcctttagtacttaccttacaacctagtctaacctaaactaaacgttccgtaagacggtaacgtaccggaaccgaaccacccggccctaaacgttaacttttagcggttgcccgaacgtaacaacgttcgaacccttcggtaccctaacgttaaacggttccggttacgggggaacccgttaaggggaaccccg

SEQ ID NO: 366218 - DNA, 651 bp, Homo sapiens
  misc_feature: GZ8MTXP01CAFWY.10.38.D05.1.454.CMB.2.raw
  modified_base (273)..(273): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtctgggttttccttgttgctatttcaaaaggtgtccactgtgaggttcaactggtggagactggaggaggctggatccagccgtgggggtccctgagactctcctgtgcagcctgtgggttcagcancagtaacgactacatcgaccgtcgggccccgcgacggctacgaggggaacggggctgggagtgggtctcgtagttatagaaacagactggcactacgattaatttattcgtagtaccgtccgggttaggaacggggtcccggtaccacccgtctaccgagtacgaactaccttaccaaactactcgttactttgtaacttccttacactatcgacctaacctaattccgacggtacgacggttaaccgaccggtaaccgacggtacccttaccggttaatttacgtttcggtacgaccggacgtaaccttagttccgaccgttaaccgcgttcctaaaggttccggttacgggggaaccccgttaaggggaaccccgg

SEQ ID NO: 366219 - DNA, 646 bp, Homo sapiens
  misc_feature: GZ8MTXP01DFXMJ.10.38.D05.1.454.CMB.2.raw
  modified_base (287)..(287): a, c, t, g, unknown or other
  modified_base (601)..(601): a, c, t, g, unknown or other
  modified_base (626)..(626): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttcaaaaggtgtccactgtgaggttcaacgtggtgggagacgtgggagggaggctgggatccgaggccgtggggggtccctgagactctcctgtgcacgcctcgtggggttcagccancaagtaacgactacatcgaccgtcgggccccgcctacggcctaccggagggggaacgggggctgggggaggtcggggttctcgtaagtttactaagaaacagagtcgggacaacttactattaatttaattcgagtaaccgttcccgggtaggaacggggtcccggttaccacccctctacgaaggtacacctaccttaaccaaactactattcttatacttccttacaacgtagtctaactaactaaactcgtaaggaagtcgtaaccggaacgaccgaccggacctaaccttaagtttattggcgcgtacgnattcgaacctgctaactagttcggnggggaacccaagggtccccg

SEQ ID NO: 366220 - DNA, 638 bp, Homo sapiens
  misc_feature: GZ8MTXP01DY5C0.10.38.D05.1.454.CMB.2.raw
  modified_base (482)..(482): a, c, t, g, unknown or other
  modified_base (565)..(565): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtgggtggagacgtggaggaggctggatccgagccgtgggggtcctgagactctcctgtgcacgtcctgtgggtcagcatcaagtaacgactacagtcgaccgtcgggccccgccgacggccgtaccggagggggaaggggcgtagggaggtcgggtctacgtagttattagaaacgagtactcggactaactaactattaaattacttcgtagtaccgtccggtaggaaccggggtccgtccaccctctcgagacactacttaccaaaacactatcttanacttctacacaggtacacaaactaatcgaagacgacggtaccgaaacgtacccgaaccggtaccctaaacggttaatttacgnggttcgaccgtacgaacttgttacgttactaaccgctaacgtacgtcggttacgggcccgttaagggaacccg

SEQ ID NO: 366221 - DNA, 793 bp, Homo sapiens
  misc_feature: GZ8MTXP01CFGAK.10.38.D05.1.454.CMB.2.raw
  modified_base (245)..(245): a, c, t, g, unknown or other
  modified_base (270)..(270): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgtacttttgtnactttataactatgtctctggtacngcaccaccaggacaaacgcccccaaacttcctttgttttgaggtcagtaacgccggtcccctcgagggacgtcccgtgtacgttcggttctctcgcctacaagtctggaccaaccgccggtccctcccgtcgacccgtctcgtcggggcctacccgaggtccgtagggacggtagtcgggaacgggtcctttaggtaaactttaccgttaacgttggaccgtaacggtccgggacttaaacgtttaacgtttacccggaaacccgggtaccccccgtaaaaacggggttagggggttttaccggggttttcgggggacccgggggtaccgggggtaaaccgttaaagggggttcccgggttaacccggtttccccggggttacgggggttccgtaaaccgggcccccggttaaaacgggggttccccttacccggggtcccccccgtttaccgggggttaaccccttacccgggtttccggtttacccccggttttccccccggttcccccccgtttcccccg

SEQ ID NO: 366222 - DNA, 727 bp, Homo sapiens
  misc_feature: GZ8MTXP01ESXCX.10.38.D05.1.454.CMB.2.raw
  modified_base (283)..(283): a, c, t, g, unknown or other
  modified_base (561)..(561): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtggaggaggctggactccaggtccggtgggggtccctgacgctctcctgtgcacgctcgtgggtcagcancaagtaacgactacagtcgaccgtcgggccccgccgaggccgtacccggaagggggaacggggtcgtggggaggtcgggttacttacgtaagtttaactaacgaaaacgtaggtaccgtaggtacctaactaaacctaatttaaactttaacgtttcgtacgtaaccccggttcccgggtaacgggtaaaccggggttccccgggttaccccaaccccgttccgtaaccgacggtaaaccgacctaacccttaaccaaaactaaccttacttacgttnttactacttacaactatacgtactaactaagactagacgacggtaccgaacgaccgaccgtacccctaagttaactttagttcggcgttaccgacgtaacagttccgttaaaccgtccgtaccttaacgtaacggttccggacggggccgttaaacggggtccccg

SEQ ID NO: 366223 - DNA, 697 bp, Homo sapiens
  misc_feature: GZ8MTXP01DNXMV.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgcttatttacaaaaggtgtccactgtgaggttcaactggtggagacgtggaggaggctggactccgaggccggtgggggtccctagacgtactctccgtgtgcacgtcctcgtgggtcagctatcgaagtaacgactacagtcgacccgtcgggccccacgaggcctacgggagggggaagggcgtagggtaggtcggggttctacgtagttatagaaacaggactcggactaactaactagttaaactttattctacggtacccgttccgggtagggtaacccggggtcccgttaccaaccccttcgtaccaagtacgaacctaccttaacccaaaactactacttaccttagtaacttccttacgaacctaggttcgaacaaacttactcgtaaggacgtacggtaacccgacgaacccgtcggtaaccctaacgtttaagtttacgttgggtcgaccggaacctagacttacggaccttaacgtccgtaacgttacggtcgggttacgggggcccgaacgggaacccg

SEQ ID NO: 366224 - DNA, 641 bp, Homo sapiens
  misc_feature: GZ8MTXP01AQAG5.10.38.D05.1.454.CMB.2.raw
  modified_base (365)..(365): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggctggatccagccgtgggggtccctgagactctcctgtgcagcctcgtgggttcagcatcaagtaacgactacatcgaccgtcgggccccgcgacggcctaccgagggggaacggggcgtgggagtgggtctacgagttatagaaacngactggctactacattaattattcgtgtaccgtccggtaggtaaccgggtccgttacacccctctaccaaggacacctaaccttaccaaactaactcttccttagtacttccttacactagtcgactaacctaaagttccgaggaacggtacgtacccggaacgaccgtacccgtcctaaacgttaatttacggttggcgaccgacgtaacttcgttcggaacctaaccgctaacgtaacgttccgggacgggggtaacccaacgggggtaacccc

SEQ ID NO: 366225 - DNA, 655 bp, Homo sapiens
  misc_feature: GZ8MTXP01AT3I8.10.38.D05.1.454.CMB.2.raw
  modified_base (279)..(279): a, c, t, g, unknown or other
  modified_base (376)..(376): a, c, t, g, unknown or other
  modified_base (585)..(585): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtggaggaggctggatccgagccgtgggggtccctgacgactctctgtgcagcctcgtggttcagcancagtaacgacacatcgaccgtcgggccccgaccgaggccgtaccggaagggggaacgggggcgtgggaggtgggttctacgtagtttatagaaacgngactggacaactactattaaatttattcgtgtaccgttccgtacgggtaacgggtcccggttacaccccgtctaccgagacgacctacctaccaaactaactattcttagtacttaccttacactatacgactaacaatccgtaggagacgtacgaacccgtaacgtcccggacctaacttaattagttcggacgttccgggacctaanacgttcggttaacctccggtacctaacgtaacgttccggggttaacgggggcccgaacggggtaaccccg

SEQ ID NO: 366226 - DNA, 631 bp, Homo sapiens
  misc_feature: GZ8MTXP01A4ZJA.10.38.D05.1.454.CMB.2.raw
  modified_base (372)..(372): a, c, t, g, unknown or other
  modified_base (463)..(463): a, c, t, g, unknown or other
  modified_base (564)..(564): a, c, t, g, unknown or other
  modified_base (582)..(582): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggctggatccgagccgtggggggtccctgagactctcctgtgcagcctctgggttcagcatcagtaacgactacatcgacccgtgggccccgccagggcctaccggagggggaacgggggcgtgggaggtggggtctcgtagtttacgtagaaacgngaactggacactacattaaattattctgaccgtcgtaggaacgggtccggttcaccctctaccagacgacacctacaaacactatccgttntactcttacactagtcacctaactaactcgtagaacgtacggtaccggaaccgtaccggaccggacctaccctaaatttgttcggtcgaccggtcgaaacncgttcgaaccggttaacnccttaacgaaccgtttcgggcgggggtaacccgaagggggtaacccccg

SEQ ID NO: 366227 - DNA, 710 bp, Homo sapiens
  misc_feature: GZ8MTXP01AXZBD.10.38.D05.1.454.CMB.2.raw
  modified_base (242)..(242): a, c, t, g, unknown or other
  modified_base (672)..(672): a, c, t, g, unknown or other
  modified_base (681)..(681): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtggggggtcccngagactctcctgtgcagcctcgtgggtcagcatcaagtaacgactacatcgaccgtcgggccccgcgacggcctccggagggggagggggctgggaggttggggtcctacgtagtttaagttacggaaaacgtgaagttcgggactaaccgttaacaatttaaacttttaacttcgttacggaaacccgttccggggttaaggggaaacccgggggttccccgggtttacccaaaccccccggtttcctacccccggtaaggaaaccggtaccttaacccctttaggaaccccaaaacctaactaacgtttccctttagttaattcctttacccaacgtaatcggacctaacgtaaacttccgtagaacggtaaacgcccggaaaccgaccgtacccgggcctaaccgttattacgtgttacgcgaccanagttcaacncgtctgaagttcggcggggccgaacgggg

SEQ ID NO: 366228 - DNA, 694 bp, Homo sapiens
  misc_feature: GZ8MTXP01BHN62.10.38.D05.1.454.CMB.2.raw
  modified_base (274)..(274): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcacgcctcgtggtcagcancaagtaacgactacatcgaccgtcgggccccgccgaggcctaccggagggggaacggggcgtgggaggtgggtctcgtagtttaataggaaacaggtactggactaactaactaatttaaactttacttccgtcgtaaccgttacccgggtacgggtaaaccggggtccccgggttaccaacccccgttcgtaccaaacggtaacgaaccctaacctttaacccaaaacctaaccttacttacgtttacgtaccttccttacaaccgtagtactaccaaactaacttccgtagaacgacgtaccggaacgtacccgaccggtccctaacttaatttagttcggtcgaccgacgtaacttagttcgaaccgttcacctcgtaaacggtttcggacgggggtaacccgaaggggtaaccccg

SEQ ID NO: 366229 - DNA, 626 bp, Homo sapiens
  misc_feature: GZ8MTXP01BM894.10.38.D05.1.454.CMB.2.raw
  modified_base (501)..(501): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgagccgtgggggtccctgacgactctcctgtgcacgcctgtgggttcagcatcaagtaacgactacatcgaccgtcgggccccgcgacggcctacggagggggaacggggctgggacggtgggtctacgtagtttattacgaaacgagtagtcggactactaactattaaatttacttctacgtaccgttccgggtaggaaccggggtcccggttaccacccgttctaccgagacgacctaccttaaccaaacactattcttagacttctacgacntacgactaacaattcaggacgtacgtaccgacgaaccgtaccgacctaacttaattacgttggcgccggcaacagttcgacctaacgtctaacgtaacgttcggacggggccgaaggggtccccg

SEQ ID NO: 366230 - DNA, 689 bp, Homo sapiens
  misc_feature: GZ8MTXP01BCIYC.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccgagccgtgggggtccctgagactctcctgtgcacgccttcgtgggttcagtcatcaagtaaccgactacagtcgacccgtcgggaccccgcgacggcctccggagggggaacgggcgtgggagtgggtctacgagtttataggaaactagagtggacaacgtataatttaaattacttcgtacgtacccgttaccgggtacggtaaaccggggtcccggttaccctaccccgttctacccgaaagggactaaccctaaccttacccaaaacgtactactttccgtaagttccttacgtactaccaggggttcaacccaaataacgtcctaaggacgtaacgttaccgaacgtcccgaaccggttacccctaggtttaattcgttcgggtcacccggtactaacgcttaacggacccttaaggacctaagtaacgttcggcggggaaccttaacgggaacccg

SEQ ID NO: 366231 - DNA, 648 bp, Homo sapiens
  misc_feature: GZ8MTXP01E3OCO.10.38.D05.1.454.CMB.2.raw
  modified_base (174)..(174): a, c, t, g, unknown or other
  modified_base (221)..(221): a, c, t, g, unknown or other
  modified_base (259)..(259): a, c, t, g, unknown or other
  modified_base (263)..(263): a, c, t, g, unknown or other
  modified_base (265)..(266): a, c, t, g, unknown or other
  modified_base (268)..(268): a, c, t, g, unknown or other
  modified_base (270)..(270): a, c, t, g, unknown or other
  modified_base (272)..(272): a, c, t, g, unknown or other
  modified_base (274)..(274): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
tcagcatagtagtgcacgaccggtgctcgatttagtatctgatagttgggtttgggctgtgaggttcaactggtggagactggaggaggctggatccagcctgggggggtccctgagactctcctgtgcagcctctgggttcagcatcagtaacgactacatgacctgggcccncaggctccgaggggaaggggctggagtgggtctcagttatagaaacngatggcactacattattatctgactccgtagacgctcnctcncnncncncncncncncnctctctctctactactactactactactactacgtacgtacggtacggtacggtaccggtaccgaccgaccccgtaccgtacgtacgttacgtacgtacgtacgtcgtacgtacgtacgtcgtacgtacgtacgtacgtacgtacggtaccggaccggaccggtaccgtacccgtacccgtccgtccgtacccgacccgcccgcccgcccgcccgccggtccgtcccgtcccgtcccgtcccgtcccgtccgtccgtccgccgtccgaccgaccgccgaaccgacgaccgaccgccgtccgtccgttccgttccgttccgtccgtccgtaaccgtaccgtaccgttacctaaccgttaaccgtaaccg

SEQ ID NO: 366232 - DNA, 648 bp, Homo sapiens
  misc_feature: GZ8MTXP01EXLFI.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccatgtgaggttcaactggtggagacgtggaggaggctggatccgagccgtgggggtccctgagactctcctgtgcagcctgtgggttcagcatcaagtaacgactacatcgacccgtgggcccccgccgagggtcctaccggaagggggaacgggggtctggggaggttcgggggtactacgtagtttaattaggaaaacgtagaacgtcgggactaacctaacatttaaatttatttccgtgtaaccgttcccgggtaggtaaccggggtcccggttaccacccccgttctaccaagacgacctaccttaccaaactactatcttagtactcttacactatcgactaactaatccgtgagtagttacgaccgtaacgacccggtacctaaccgtaatttattcggcttacggctaacagttgacctaagtctaactagtccggttgggggaacccaaggggaacccg

SEQ ID NO: 366233 - DNA, 637 bp, Homo sapiens
  misc_feature: GZ8MTXP01C3OJH.10.38.D05.1.454.CMB.2.raw
  modified_base (566)..(566): a, c, t, g, unknown or other
  modified_base (625)..(625): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggactccgaggcccgtgggggtcccctgacgactctcctgtgcacgtcctcgtggtcagcatcaagtaaccgactaacagtcgacccgtcgggccccgccgacgggcctccggagggggaacggggcgtgggtaggttcgggtctcgtagtttattagaaactagtacgtggactacgtactattaacttattccgtagtaccgtcccgggtaggaaccgggtcccgttaccacccttcaccaggacaccctacctaccaaacactattcctagtacttcttacactaagtcgactaacacgtcgagaggactaccgaccgacgacccgtcctacgtaatttacgnggtacgccgactaacttgttcaacgtccgtactaacgtaacgtcggggacgggaaccgnggggtaaccccg

SEQ ID NO: 366234 - DNA, 709 bp, Homo sapiens
  misc_feature: GZ8MTXP01AH57R.10.38.D05.1.454.CMB.2.raw
  modified_base (626)..(626): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagcttgggttttccttgttgcttatttcaaaaggtgtccactgtgaggttcaactggtggagactggaggaggctggatccgagccgtgggggtccctgagctctcctgtgcagcctcgtggttcagcatcaagtaacgactacatcgaccgtcgggccccgcgacggcctccggaagggggaacgggggccgttaggggaggttcgggggttctacgtaagtttaattgaaaacccgtagagtggaccctacgttaaacaatttaagttacttaccgtcgggtaaccgttacccgggtaggggaaaccggggttcccccggtttacccaaccccgttccgtaccgaaaggaaccgtaccctaaccctttacccaaaaccgtaacttaacttctttactaacttcccttacaacgtattaccgacaactaacgtcgtagaacgacgtccgaaccgaccaacccggtcctaaaccgtttnttaacgttcggtcgcggttaacgccttattcggaacccttaacggtccttaacggttacgtttcccgggaacggggtcccggg

SEQ ID NO: 366235 - DNA, 570 bp, Homo sapiens
  misc_feature: GZ8MTXP01BFIH4.10.38.D05.1.454.CMB.2.raw
  modified_base (360)..(360): a, c, t, g, unknown or other
  modified_base (462)..(462): a, c, t, g, unknown or other
  modified_base (547)..(547): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcgtggttttcctgtgctattcaaaaggtgtccactgtgaggttcaactggtggagacgtggaggaggctggatccagccgtggggggtccctgagactctcctgtgcagcctgtgggttcagcatcagtaacgactacatgaccgtcgggccccgccaggctaccgagggggaagggggcgtgggaggtcgggtctcgagtttattagaaacngagtggactaactactattaaattattctagtaacctccggtaggacggggtcccgttccaccctctaccgaggtacactacttacccaaactactatcttntactcttacacatcgactacaactgtagacgtagtaccgacgtaccacggcctaactaatttgttgcgcgcacattcgactgctnaacgtcgcgggtccgaagggccc

SEQ ID NO: 366236 - DNA, 875 bp, Homo sapiens
  misc_feature: GZ8MTXP01A3NSW.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagtctctcctgtgcacgcctcgtgggttcagcatcaagtaacgactacagtcggacccgtcgggccccgccgacgggccgtaccgggaaggggggaacgggggcgttagggggacgggtttcgggggttaccttacggttaaggtttaacgttaacggaaaaccgtaggtaacggttcgggacctaacgttaacctaatttaaaactttaacgtttccgtacggtaacccgttacccgggttacggggaaacccgggggttccccggtttaaccctacccccgttacgttacccgaaacggaaccggtaaccctaaacccctttaacccgaaaaacctaaaccttaccgttttaccgtttacggttaaaccttacctttaccaacctaaggttaccggaacctaaaccttaaacgttccgttaagggaacggtaaccggttaacccggaacccggtaaacccggaccccgggtaaccccttaaaccgtttaagttttaagtttccgggtaccggaaccggtaccgtaaacgttacgttacccggttaaaccgttaacccgtaccgttaaccgttaaacgggtttcccgggggaacccggggggtaacccggttaaaacggggggtcccccgg

SEQ ID NO: 366237 - DNA, 735 bp, Homo sapiens
  misc_feature: GZ8MTXP01AV1L7.10.38.D05.1.454.CMB.2.raw
  modified_base (665)..(665): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtggggggtccctgagactctcctgtgcaggcctgtgggttcagcatcagtaacgactacagtcgacccgtgggcccccgaccgagggccgttacccggaggggggaaacgggggtccgtagggggtacggttcgggggttaccttccgtaagggttttaattacgggaaaaacccacgggtaagttacgggggaacctaaaccgttaaccgtaagtttaaaacgttttaacctttccgttacgggtaaaccccggttccggggttaacgggtaaaccggggggtccccggtttaccaaacccccggttcttacccgaaaggtaacgacctaacccttaccaaacgtaaccctattccggttataactcttacacgagtcactaacaagttccgagagacgtacgacgtacaccggtcctactaattacgttggcncgacgaacttagttcgacctaacggtcctaacgtaaacgttccgggacgggtcccgaacggggaaccccg

SEQ ID NO: 366238 - DNA, 607 bp, Homo sapiens
  misc_feature: GZ8MTXP01BI444.10.38.D05.1.454.CMB.2.raw
  modified_base (361)..(361): a, c, t, g, unknown or other
  modified_base (424)..(424): a, c, t, g, unknown or other
  modified_base (492)..(492): a, c, t, g, unknown or other
  modified_base (529)..(529): a, c, t, g, unknown or other
  modified_base (552)..(552): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtggggggtccctgagactctcctgtgcagcctcgtgggttcagcatcaagtaacgactacatcgaccgtcgggccccgccgaggcctccgaggggaagggggctgggagtgggtctcgagttactgaaacngactggacactacattaattattctagtacctccggtaggaacgggtcccgttacaccccgtntaccgagacgacaccttacaaacactattcgttactaactccttacgactattcgactaaacattcgngaagtacgtaccgaactaccgaccggccctaacgttntttaacgttgtcgccgacgaacngttcggaccttaacggctaacgaagtttcggacggggaacccttaagggggcccc

SEQ ID NO: 366239 - DNA, 700 bp, Homo sapiens
  misc_feature: GZ8MTXP01COWWQ.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttcaaaaggtgtccactgtgaggttcaactggtggagacgtggaggaggctggatccagccgtgggggtcctgagactctcctgtgcagcctcgtgggttcagcatcaagtaacgactacagtcgaccgtcgggccccgccgacgggcctccggagggggaacgggggcgtgggaggtcgggtctcgtagttataggaaacaggacgtggacactaactattaaactttacttcgtgtaccgtccggtagggaaccgggtcccggttaccaccccgttctacccgaacggtaactaacctaaccctttaacccaaaacttaaccctatttacccgtttacgttaacttcctttacaaactacggttacgacctaactaaacttcgtaccgaaggacggttaccggaacgtacccgaaccggtacccttaaaccgttaatttacgttcggtacggccgtaacgcttaacgttcgttaaacccgtcgacttaacgtaacgtttcgggacggggtccgaacggggtaaccccg

SEQ ID NO: 366240 - DNA, 607 bp, Homo sapiens
  misc_feature: GZ8MTXP01DL6JO.10.38.D05.1.454.CMB.2.raw
  modified_base (557)..(557): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcacgcctcgtgggtcagcatcaagtaacgactacatcgacccgtcgggccccgccgaggcctaccggagggggaacgggggcgtgggaggtggggtctacgtagtttattagaaacagactcggacactactattaaacttattcgtgtaccgtccggtaggaaccggggtcccggttccaccctctccaaggacacctaccttacccaaacaactattccttagtacttcttacacctatcgacaactaatctagagacgtaccgaacgacgaccgcctaacttaattattgtcgcgcganacgttgaacctcgctaacaacgttcggttacgggggccaaggggaacccg

SEQ ID NO: 366241 - DNA, 622 bp, Homo sapiens
  misc_feature: GZ8MTXP01AWGE2.10.38.D05.1.454.CMB.2.raw
  modified_base (302)..(302): a, c, t, g, unknown or other
  modified_base (357)..(357): a, c, t, g, unknown or other
  modified_base (571)..(571): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatgacctgggccccncgaggctccgagggggaacggggctgggagtggggtctcgtagttattagaaacngatggactacgtacattaacgtttaatcgtagtaaccgttccggtaggaacggggtcccggttactaaccccgtctaccaggtaacgacctaaccttaccgaaacaactacttcttagtaacttctacaaccattacggctaaacaaacgtcctaggacggtacgtaccgaacgacgtaccgacctaccttaattacgttgtcgacgcgtaacngttcgacttaacggccttaacgaacttcggcggggaaccgttgggaacccg

SEQ ID NO: 366242 - DNA, 600 bp, Homo sapiens
  misc_feature: GZ8MTXP01ACQ5S.10.38.D05.1.454.CMB.2.raw
  modified_base (275)..(275): a, c, t, g, unknown or other
  modified_base (358)..(358): a, c, t, g, unknown or other
  modified_base (362)..(362): a, c, t, g, unknown or other
  modified_base (382)..(382): a, c, t, g, unknown or other
  modified_base (429)..(429): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtagagactggaggaggctggatccgagccgtgggggtccctgagactctcctgtgcagcctctgggttcagcancagtaacgactacatcgaccgtcgggccccgccgaggcctccgaggggaaggggctgggagtgggtctcgagttatagaaacngacnggacactacataattattcngactcgtgaacgggtcgtcaccctctccagacaccacttacaactanattccttgatcttgaccatgaccacaattcagacgagtccacgtaccacggccctaaccttaattaagttgtcgaccgcgtaaacttcgttgggaaacccttaaccggggtactaaccccggtttaaaagttcccgggttacggggggtccccgaaagggggtaaccccgg

SEQ ID NO: 366243 - DNA, 678 bp, Homo sapiens
  misc_feature: GZ8MTXP01D6SBO.10.38.D05.1.454.CMB.2.raw
  modified_base (283)..(283): a, c, t, g, unknown or other
  modified_base (507)..(507): a, c, t, g, unknown or other
tcagcatagtagtgcacgaccggtgctcgatttagtatctgataggttgggtttggggggagaggagcccagcactgggattccgaggtgtttccattcggtgatcagcactgaacacagaggactcaccatggtagttttggctgagtcttgggttttccttgttgcttatttacaaaaggtgtccatgtgaggttcaacgtggtggagacgtggaggaggctggactccgaggccggtgggggtccctgagtactctctgtgcacgtcctgtggtcagcanacaagtaacgactacacgtcgaccgtcgggccccgacgacgggccgtaccggaagggggaacggggtcgtagggggtaggttcggggttactacgtaagtttaataaggaaacgagtacgtcggactaactaactattaaatttattcgtgtaaccgttccgggtagggtaaccgggtcccgtacacccctgtaccaagacacctaacttaaccgaaactactnttcgttatactcttacactaggtcaactaagtaatcgtaaggagacgtaccgaacgtaccgacgtaccctaagttaatttacgttggtaaccgcggtaaacgtcttaagttccgaaaccttaacgcttaacgtaacggtccgggacggggtaaccccaagggggtaacccc

SEQ ID NO: 366244 - DNA, 694 bp, Homo sapiens
  misc_feature: GZ8MTXP01ASM7G.10.38.D05.1.454.CMB.2.raw
  modified_base (284)..(284): a, c, t, g, unknown or other
  modified_base (373)..(373): a, c, t, g, unknown or other
  modified_base (449)..(449): a, c, t, g, unknown or other
  modified_base (521)..(521): a, c, t, g, unknown or other
  modified_base (604)..(604): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtggaggaggcgtggactccgacgccgtgggggtcctgagactctccgtgtgcacgccgtcgtggtcagcanacaagtaacgactacatcgaccgtcggccccgccgacggccgtaccgaggggacgggcgtggaggtgggtctgtagttatagaaacagntcggacactaactattaaagttacttcgtacgtaccgtccgggtacggtaaccggggtcccggtaccctacccctntacccgaaggtaccgaccttacctaaccaaaactacttatctttacgtacttcttaccaattacggggttanaacctaacgtaactccgtaggacgtacggtacccgaccgggtaaacaccggtacccctaatttaactttaagttcggggaccnccggaactaaccgttagttccgttaaccgttaaccgtacgttaaccgttaagggttccggggaccgggggccgttaacggggtaaccccg

SEQ ID NO: 366245 - DNA, 682 bp, Homo sapiens
  misc_feature: GZ8MTXP01B1NCF.10.38.D05.1.454.CMB.2.raw
  modified_base (269)..(269): a, c, t, g, unknown or other
  modified_base (358)..(358): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgtaggttcaactggtggagacgtgggaggaggctggatccgagccgtggggggtccctgagacctctcctgtgcagtcctntgggttcagcatcagtaacgactacatcgacctgggcccgccaggcctcgaggggagggctgggagtgggtctcgtagttatagaaacngacgtggacaacgtacattaaacttattcgtcgtaactcccgggtaggaaaccggggtcccgggttacaacccccttcgtacccgaaggtacggaacctaccctttacccaaaacctaaacctttacttaccgttagtacttacccttacaacttacgtacgtaactaacctactcgaggtacgtacgtaccggaaccgtaaccgtaccgtacctaaccttaagtttacgttcgggtacggccgtacgtacttacgttccggttaccgttaaccgcttaacgttaacggttcgggttaccgggggaaccgttaacggggtcccg

SEQ ID NO: 366246 - DNA, 631 bp, Homo sapiens
  misc_feature: GZ8MTXP01DKYTP.10.38.D05.1.454.CMB.2.raw
  modified_base (173)..(173): a, c, t, g, unknown or other
  modified_base (204)..(204): a, c, t, g, unknown or other
  modified_base (216)..(216): a, c, t, g, unknown or other
  modified_base (262)..(262): a, c, t, g, unknown or other
  modified_base (568)..(568): a, c, t, g, unknown or other
  modified_base (586)..(586): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccncaggctccgagggagggctggagtgggtctnagttatgaaacngatggcactacattattatctgactcgtgaacgggccgttcacctnaccagagacacttccaaactaactattcttagtactcttacactatgacaacgaattctagtagacggtcgaaccgaccgacggaccctaacccttatttaacgtttggacgccgaccgaacctgtacgacccttaacggccttaacgtaaggtttcgggcgggggaccctaggggaccgacccgacgggtccaacccggttaccctaccccacgcccctaccgaacccgaacgggacccctacgttcccggggtcccttccccgtggcccgtcctccgactccgaggcgtccacctccgagaacnccaacgcggccggtccgnggcttcgccgttggactaacggtcctaccttaccaacttaactcg

SEQ ID NO: 366247 - DNA, 634 bp, Homo sapiens
  misc_feature: GZ8MTXP01DBZTY.10.38.D05.1.454.CMB.2.raw
  modified_base (383)..(383): a, c, t, g, unknown or other
  modified_base (411)..(411): a, c, t, g, unknown or other
  modified_base (486)..(486): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgctatttcaaaaggtgtccactgtgaggttcaactggtggagacgtggaggaggctggatccagccgtgggggtccctgagactctcctgtgcacgtcctcgtgggttcagcatcaagtaaccgactaacatcggacccgtcgggcccccgccgacgggcctaccggagggggaacgggggtcgtagggagttcggggttctacgtagttatagaaacngactggactaacgtacattaattattcngaccgtcgtagaaccgggtccgttccaccctctcaagacactacttaccaaacactattctagtactctacactntcgacaaacactcgtagagacgtaccgaccgtaccgacgtccctaaacgttaagtttattcggtcgaccgtacgacttaacgttcgttaaccctaacggtccttaacgtaacgtttccgggacggggaacccgaacgggggtaacccc

SEQ ID NO: 366248 - DNA, 696 bp, Homo sapiens
  misc_feature: GZ8MTXP01EZXCV.10.38.D05.1.454.CMB.2.raw
  modified_base (277)..(277): a, c, t, g, unknown or other
  modified_base (514)..(514): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagcccgtgggggtccctgagactctcctgtgcagcctcgtgggttcagcancaagtaacgactacatcgaccgtcgggccccgccgaggccgtccggaagggggaacgggggcgttagggggaggtttcggggtccttacgtaagttttaagttaggaaaacgagtaagtcgggactaacgtaactaattaaatttatttcgtacgtaccgttaccgggtaggtaaaccggggtcccgttaccgaacccctcgtaccgagaacgtacctaaccttaccaaactaactnttaccttagtaactcttacaactatacgactaaactaagtcctagacgtacgtaccgaaccgtaccgaccggtaccctaacgttaatttagttcgggcgttacgcgtaacacgttcggaacctaaccggtaccttaacaaacggtttccgggacgggggtaacccgaacgggggtaaccccg

SEQ ID NO: 366249 - DNA, 678 bp, Homo sapiens
  misc_feature: GZ8MTXP01D1CA3.10.38.D05.1.454.CMB.2.raw
  modified_base (263)..(263): a, c, t, g, unknown or other
  modified_base (505)..(505): a, c, t, g, unknown or other
  modified_base (524)..(524): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgcttatttacaaaaggtgtccactgtgaggttcaactgggtggagacgtgggaggaggctggatccgagccgtgggggtccctgagactctcctgtgcncgcctgtcgggttcagcatcaagtaacgactacagtcgaccgtcgggccccgcgacgggcctacggaagggggaacgggggcgtggggagttcggggtcttacgtagtttaacgttaagaaacgaggtactacggactaaactaactatttaaactttaacttcgtacgtaccgttacccggtagggaaccgggtccccggttaccacccttcgacaaggacacctaccttacaaacacttntccttgtactctacaactntacgactaaacgtattcgaggacgtacgtaccgaaccgtaccgaccggtaccctaactttaattacgttcggcgaccggtaactaacgttagttaccggaccttaaccggtcttaacgtaaccgttcgggacggggtccgaacggggtaacccg

SEQ ID NO: 366250 - DNA, 743 bp, Homo sapiens
  misc_feature: GZ8MTXP01ACB6O.10.38.D05.1.454.CMB.2.raw
  modified_base (285)..(285): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgctatttacaaaaggtgtccactgtgaggttcaacgtggtggagacgtggaggaggctggactccgagccgtcggggggtccctgacgactctccgtgtgcacgcctcgtgggttcagcancaagtaacgactacacgtcgacccgtcgggccccgaccgaggccgtaccggaagggggaacgggggtctgggggtaggttgggggttacctacggtaagtttaacgtacggaaaacaggtaccgtggacctaacttaacctatttaaaactttacgttccgtacggtaacccggtttaccgggtacgggtaaaccgggggttccccgggttaccctaccccggttcctacccgaaggaccaacctaaccttacccaaaactactacgttacttactacttccttacaaccagttacactaactaacgtcgtagacgtacgacggaccgaacgacccggtcctaaccttaagttcgttcggacgaccggtacctaacttacgttacggaacccttaacccgtactaaccgttaacgggtttcccgggacgggggaaccccgttaaagggggtccccccg

SEQ ID NO: 366251 - DNA, 652 bp, Homo sapiens
  misc_feature: GZ8MTXP01EO4Q7.10.38.D05.1.454.CMB.2.raw
  modified_base (257)..(257): a, c, t, g, unknown or other
  modified_base (495)..(495): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtggaggaggctggatccgagccgtgggggtcctgagactctctgtncagcctgtgggtcagcatcaagtaacgactaacatcgaccgtcgggccccgcgacgggcctaccggaagggggaaacgggggcgtagggacggtgggttactcgaggtttatagaaaacgagtacgtggacactaactaattaaacttattcgtagtaccgttccggtagggaaccggggttcccggtacaccccgttcaccgacggaactacctaaccttaccaaacgtaaaccttnttacttagtactctaacgaactagtacgaacctaactaactcgaagaacgtacggaaccgacgtaacctaccggtacctaacttaattcgttcgcgacgacaacttagttcacgtctacgtaacgtacggtcgggttcgggaaccgaagggtaaccg

SEQ ID NO: 366252 - DNA, 679 bp, Homo sapiens
  misc_feature: GZ8MTXP01C0TZV.10.38.D05.1.454.CMB.2.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtgggaggaggctggactccgaggccggtgggggtccctgagactctcctgtcgcacgcctcgtgggtcagcatcaagtaaccgactaacagtcgacccgtcgggccccgccgacggccgtaccggaagggggaacgggggtcgtaggggtacggttcgggttacctacggttaagtttagttaagaaacgagtacgtcggactactaactatttaaactttacttcgtacgtaccgtaccgggtacggaaccggggtcccgttaccaccctcgtacgaggacactaccttaccaaactactattcttagtactcttaacacaggtacactaactagtctagaacgtcgtaacggacctaccgaccgtacctaacctttaagttcttggcgcgtaaccgacttaacgttccggaaaccttccggacttaacgtaacgttcgggacggggtaaccgaacgggggtaacccg

SEQ ID NO: 366253 - DNA, 699 bp, Homo sapiens
  misc_feature: GZ8MTXP01CE44M.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgacgactctcctgtgcacgcctcgtgggttcagcatcaagtaacgactacacgtcgacccgtcgggccccgccgaggcctcggagggggaacggggcgtgggagtgggtctacgtagttatagaaacagacgtcggactacgtactattaaattacttctacggtaccgttaccgggtacggaaaccgggggtccccggttaccaacccccttcgtaccccgaaggtaaccgaacctaaccttaacccaaaactaacctattcccgtttataaccttaccttacaaactagttacaacctaaacctaaatccgtaaggaacgtacggtaaccggaacccgtaaccgacccggtacccttaaacttaacgtttagttcggtccgacgtacgaacttagttccgttaccgtaactccgtaacttacggttccgggacgggtaacccgaagggggaacccc

SEQ ID NO: 366254 - DNA, 784 bp, Homo sapiens
  misc_feature: GZ8MTXP01ECVJB.10.38.D05.1.454.CMB.2.raw
  modified_base (261)..(261): a, c, t, g, unknown or other
  modified_base (280)..(280): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaactgggtggagactggaggaggctggatccgagccgtgggggtccctgagactctcctgtgcncgcctcgtgggttcagcanacaagtaaccgactacatcggacccgtcgggccccgccgacgggccctaccgggaagggggaaacgggggcgttcgggggtaaggttcgggggtttccttacgtaagttttaacgttaggaaaaccgaggtagtacgggtacctaacgttaactatttaaaactttacgttaaccgtaccggtaacccgttacccggggtaacggggtaacccgggggttcccccgggttaccctaacccccgtccgtacccgaacggtaacaccctaacccttaacccaaaacctaacttacttcgttaactacttccttacacctaggttacactaactaaacgtcgtaacggaagtacgtaacccggaccgaaccggtacccggtaccttaactttaagtttacgttcggtacgcccgggaactaaccgttagttacccgttaacccgttaacggaccctttaacggtaaacgtttccgggaccgggggaacggttaacccggggaacccg

SEQ ID NO: 366255 - DNA, 781 bp, Homo sapiens
  misc_feature: GZ8MTXP01C6S7D.10.38.D05.1.454.CMB.2.raw
  modified_base (294)..(294): a, c, t, g, unknown or other
  modified_base (586)..(586): a, c, t, g, unknown or other
  modified_base (602)..(602): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgcttatttacaaaaggtgtccactgtgtaggttcaacgtggtggagacgtgggaggaggcgtggactccgaggccggtgggggtccctgacgtactctccgtgtgcacgtcctcgtggggttcagcanacaacgtaacgtactaacagtcggacccgtcgggccccgccgagggtccgtaccggaaggggggtaacgggggctagggggtacggttcgggggtttactacgttaaaggtttaagttaacggaaaacgtaggtaaccgtacgggactaacgttaactaagtttaaacttttaacgttcgtacggtaaccgttacccgggttacggggaaacccgggtccccggtttacccaaccccttcgtacccgaaacgtacgaaccctaaccttaacccaaaactaactattacgttntaactcttacgaactntacgacaactattcgtagacgtacggtaccggaaccgaccgtaaccggccctaaaccgtttaagtttacgttcggtaccggccgttaacggaacttaacgccggttaaaccgttaacccggtacttaacgttaaacggtttccgggacggggggaacccgttaacggggggtaaccccg

SEQ ID NO: 366256 - DNA, 668 bp, Homo sapiens
  misc_feature: GZ8MTXP01DX1D5.10.38.D05.1.454.CMB.2.raw
  modified_base (391)..(391): a, c, t, g, unknown or other
  modified_base (504)..(504): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtggaggaggctggactccgaggccgtgggggtccctgacgactctcctgtgcacgcctcgtgggttcagcatcaagtaacgactaacagtcgacccgtcgggccccgaccgagggccgtaccggagggggaacgggggcgtggggaggtggggttctacgtaagtttattacgaaacngatggactaactactattaaattattcgtgtacccgttaccgggtaggaaccggggtcccggttaccaccccttctaccgaaggacgaccctaaccttacccaaaactaactntttccgttataacttccttacaacctagttacactaaacctaattccgtaggaacgacggtaaccgaccgaaccgaccggtacctaacgttaattcgttggcgacgtacacttagttcgaacctcgactcgtaagttcggacggggccgttaaggggaaccccg

SEQ ID NO: 366257 - DNA, 647 bp, Homo sapiens
  misc_feature: GZ8MTXP01CD4UG.10.38.D05.1.454.CMB.2.raw
  modified_base (274)..(274): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagacgtggaggaggctggatccagccgtggggggtccctgagactctcctgtgcagcctctgggttcagcancagtaacgactacatcgaccgtgggccccgcgaggcctccgagggggaagggggctgggagtgggtctcgtagttatagaaacagactggcactacataattattctgactccggtggaacgggtccggttcacccttctccaggacgacctacttacccaaacactattccgttagtacttccttacaacctatcgacctaactaagtcgtagaacggtacgtaccggaaccgtaccgacccgggtaccctaaacccgttaagttttacgtttcgggtacgccgggttacaaccttacgttcgaacccgttaaccggtacttaaccgtaaagttttccggggcgggggaaccccgttaacgggggaaccccg

SEQ ID NO: 366258 - DNA, 670 bp, Homo sapiens
  misc_feature: GZ8MTXP01EIO3W.10.38.D05.1.454.CMB.2.raw
  modified_base (279)..(279): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccgagccgtgggggtccctgagactctcctgtgcacgcctcgtgggttcagcancaagtaacgactacatcgacccgtcgggccccgccgacggccgtacccggagggggaaagggggccgtgggggaggttcgggggttacttacgtaagtttaagtaaggaaacagggtacttgggactaactaactattaaattacttctgacctccggtacggaacggggtcccggttaccacccctctacccgaagacgacctaccgttacaaacactatccttatactcttacactatacgacctaaactaatccgtaggaacggacgttaccggaaccgtaaccgacccggtacctaaaccttaagtttaacttgggcgcgacgaacttattcggaacctaacgcttaacaagttccggttacggggcccgttaaagggggaaccccg

SEQ ID NO: 366259 - DNA, 659 bp, Homo sapiens
  misc_feature: GZ8MTXP01BW3KG.10.38.D05.1.454.CMB.2.raw
  modified_base (365)..(365): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagctctcctgtgcagcctcgtgggttcagcatcagtaacgactaacatcgaccgtcgggccccgccgacggcctccggagggggaagggggcgtgggaggtgggtctcgtagttatagaaacngactggacactactattaaattacttcgtcgtacccgtacccgggtagggtaaccggggtcccggttaccaccccgttctacccaaggacgtacctacctttacccaaaactaacctattccgttataacttccttacactagttcaccaactatcctaggagtacggtaccgaccgaaccgaccggaccctaaccgtttaatttacgttggtcgccggacgtaacagttcggaaccttaacggccttaaccgtaaacgttccggttcggggggaacccaagggggtaaccccg

SEQ ID NO: 366260 - DNA, 681 bp, Homo sapiens
  misc_feature: GZ8MTXP01AS02U.10.38.D05.1.454.CMB.2.raw
  modified_base (277)..(277): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggactccgagccgtgggggtcctgagactctcctgtgcacgcctgtcggttcagcancaagtaacgactacatcggaccgtcgggccccgaccgacggccgtaccggaagggggaacgggggtcgtagggggaggttcggggtctacgtagtttattacgaaacgagacgtacggactaacctactaatttaactttacgtttcctacggtaaccgttcccgggtacgggtaaccgggggtccccggtttacccaccccgttccgtacccgaacggtaaccaacctaaccttaacccaaaacctaacttacttaccgtttatacttccttacaacacgttcactaactaatccgtaggacgtacgtaccgacaccggacctaacctacttaatcgttgacgctacgacttacgttcactaacgtctaacgtacgttcgggacgggtccggaacggaacccg

SEQ ID NO: 366261 - DNA, 663 bp, Homo sapiens
  misc_feature: GZ8MTXP01D2PBD.10.38.D05.1.454.CMB.2.raw
  modified_base (366)..(366): a, c, t, g, unknown or other
  modified_base (523)..(523): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctattcaaaaggtgtccatgtgaggttcaactggtggagactggaggaggctggatccaggccgtggggggtccctgagactctcctgtcgcagtcctcgtgggttcaggcatcagtaacgactacatcgaccgtcgggccccgccgaggcctaccgaggggaggggcgtgggagtgggtctcgtaggttatcgaaaccngatcggactaccgtaaactattaacgtttattcgtaggtaacttccccgggtagggaaaccggggttcccggtttacccaacccgtctaccgagtaacgaacctaacccttaccaaaactacatttccgttataaacttccctttacgaaaccgttntacgaccaacgtagtcgtaggaacgtacgtaccgaaccgtaccgtaccggtaacccttaactttagttacgttcggacgtaccgttacgttacttacgtaacgtactaacgtctacgttaacgttcgggccggggtaacg

SEQ ID NO: 366262 - DNA, 650 bp, Homo sapiens
  misc_feature: GZ8MTXP01AGUYI.10.38.D05.1.454.CMB.2.raw
  modified_base (374)..(374): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgctatttcaaaaggtgtccactgtgaggttcaacgtggtggagacgtggaggaggctggactccgagccggtgggggtccctgacgactctccgtgtgcagcctcgtgggttcagcatcagtaacgactacatcgaccgtcgggccccgcgacggcctaccggaagggggacggggcgtgggaggtgggtctacgtagtttatagaaacngactcggactactactattaacttacttcgtcgtaccgtccgggtagggtaaccgggtccgttaccaccccttctacgaacgacgtaacctaccttaccaaactactattctttacgtacttctacgaacacgtcgacctaactaactcgtagagacgtaccgaacgaccgaccgtacctaacttaagtttacgttcggacgccgtccgtaaattcgcggttaacctaacgcttaacgtaacgttcggggaccgggtaaccgaacggggaaccccg

SEQ ID NO: 366263 - DNA, 638 bp, Homo sapiens
  misc_feature: GZ8MTXP01AW5BK.10.38.D05.1.454.CMB.2.raw
  modified_base (253)..(253): a, c, t, g, unknown or other
  modified_base (268)..(268): a, c, t, g, unknown or other
  modified_base (382)..(382): a, c, t, g, unknown or other
  modified_base (405)..(405): a, c, t, g, unknown or other
  modified_base (449)..(449): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctctgcactggaaccagcagtgtactttgtgacttataactntcgtctcgtgtaccngaccaccaccagacaaacgcccctaaattcctttagtttgacgtcagtaacgcgcctagaggtacgtcctgacttcggttctctaccgcctacgtaagtctacggaaccaaccncggccctacccgtgacccgttcncgtcggctcgagtcgtgacgagtggagtctagtacttactacgnacagcgctaaggtaccttaccggaaccgtaccccgtaaggtacgggtttcgggttcgggccgggtacggtaaccggtaacgggtccggtaccggttacggtccgggttaccgtaccgcccggttaacggccgttccccgtccccggtcgtccctaacggtcccttacccgttccccaacccgtttcccc

SEQ ID NO: 366264 - DNA, 695 bp, Homo sapiens
  misc_feature: GZ8MTXP01EQAKY.10.38.D05.1.454.CMB.2.raw
  modified_base (309)..(309): a, c, t, g, unknown or other
  modified_base (312)..(312): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgagggaaggggctgggagtgggtctcagttattgaaacagatggcactacatattattctgactcgtgagggccggttcacctctcagagacacttcaacacatcttgtatctcacatgcaacatcnganagtcgacgacaccggcaaccccttattattgtgcaaacgacaatgaccttacgctactaacttcgtacgggggtccaggggacaccccgagggttcccaacccggttccctacccccgtacggaccccttaccccgaaaccccgaaaccgggggtcccctaaccggttccccgggggttaccccttttccccccggtcgggtcccccgggtcccctccgtccccgtacccggaacggggtacccgacccgtaccccgtaccccgggaaggtccggacccgacccgacgggcccggggccccgtttcgggggcccgttccggttaccccggtgggtacccgtaaacgggtacccttaccttaccccgtaactttaacgttaacg

SEQ ID NO: 366265 - DNA, 565 bp, Homo sapiens
  misc_feature: GZ8MTXP01DX0TK.10.38.D05.1.454.CMB.2.raw
  modified_base (264)..(264): a, c, t, g, unknown or other
  modified_base (301)..(301): a, c, t, g, unknown or other
  modified_base (331)..(331): a, c, t, g, unknown or other
  modified_base (349)..(349): a, c, t, g, unknown or other
  modified_base (354)..(354): a, c, t, g, unknown or other
  modified_base (366)..(366): a, c, t, g, unknown or other
  modified_base (392)..(392): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcgtgggttttcctgttgctatttacaaaaggtgtccactgtgaggttcaactggtggagactggaggaggctggatccagccgtggggggtccctgagactctcctgtgcagcctntgggtcagcatcagtaacactacatgacctgggcccncaggctccagggaagggctggagtgggtcnagttatgaaacagatggnactanataattaacttngactacgtagacgggtcctacacctnacagacacactacaacaactatctatatctacacacgtacacaacaatactgagacgtacgaaccgtaaccgaaccgaccctaacctaattaacgttagtacgcgacgtaacaacgttcgttacgtaaccgtactaacgtaactacggttacggggtaaccggaacgggaacg

SEQ ID NO: 366266 - DNA, 674 bp, Homo sapiens
  misc_feature: GZ8MTXP01A6GYZ.10.38.D05.1.454.CMB.2.raw
  modified_base (328)..(328): a, c, t, g, unknown or other
  modified_base (663)..(663): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagcttgggttttccttgttgcttatttcaaaaggtgtccactgtgaggttcaacgtggtggagacgtggaggaggctggactccgaggccggtggggggtccctgacgtaccgtctcccgtggtgcacgtcctcgtgggttccagcatacaagtaaacgactacagtcgaccgtcgggcccnccgaggcctcggaagggggaaggggcgtgggtacggtgggtctacgtagttagttacgaaactagactggacactacattaattatctagacgttccggaggtaaccgggtccggtacctacccgtctaccgaggacactacctaccaaacgaactactccttatactccttacaacgtacgtacgtactaaactacgtaccgtaggaacgaaccgttacggaaccgtaaaccgaccgggtacctaacccgttaatttacgtttcggtacgccgacgtaacttacgttcgttacctaaccggcttaaccgttaagtccggttacggggtaaccgnggggaaccccg

SEQ ID NO: 366267 - DNA, 623 bp, Homo sapiens
  misc_feature: GZ8MTXP01EWV7Q.10.38.D05.1.454.CMB.2.raw
  modified_base (276)..(276): a, c, t, g, unknown or other
  modified_base (506)..(506): a, c, t, g, unknown or other
  modified_base (574)..(574): a, c, t, g, unknown or other
  modified_base (590)..(590): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggtttttccttgttgcttatttcaaaaggtgtccactgtgaggttcaactggtggagacgtggaggaggctggatccgacgccgtgggggtcctgagactctctgtgcagcctcgtggtcagcancaagtaacgactacatcgaccgtcgggccccgaccagggcctccggaagggggacgggggctgggaggtcgggtctacgtagttactagaaacgagtacgtggacactaactacttaaattacttcgtacgtaccgttccgggtaggtaaccggggtcccgttcctaccccgtctaccgaggacgtaacctaccttaccaaacaactcgttcttacgtactcttacaacngtacacactaatcgtgacggactacggaaccgtcaccggtacctactaattcgttggcgcgaacgacngttcttaacctccggntaacgtacgttcgcggggccttaagggaacccg

SEQ ID NO: 366268 - DNA, 725 bp, Homo sapiens
  misc_feature: GZ8MTXP01EPOUX.10.38.D05.1.454.CMB.2.raw
  modified_base (405)..(405): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttacaaaaggtgtccactgtgaggttcaactggtggagacgtgggaggaggctggactccgacggtccggttcgggggtccctgacgacttcctccgtgtgcacgcctcgtcgggttcagcatcaagtaaccgtactacagtcgacccgtcgggccccgccgacgggccgtccggaagggggaacgggggcgtgggggtaggtgggggttctacgtagtttatagaaacagtacnggactactaactataaatttattcgtcgtacccgtccgggttacggaaccggggtcccgttaccctacccctactaccgaacgaccgaacctacctaacctaaacctaaacttacttacttagttacttccttaacgactactcgtaaccaactacttaccgaggtaacgtaccggtaccgaacccgaccgaacccggtccctaaccctttaagtttacgtttcggacggttaccgaccggtaacttcgttccgttaaccgttccgaccttaacgtaacgttcggggttaccggggaacccgttaacgggggtaaccccg

SEQ ID NO: 366269 - DNA, 585 bp, Homo sapiens
  misc_feature: GZ8MTXP01AM3B7.10.38.D05.1.454.CMB.2.raw
  modified_base (259)..(259): a, c, t, g, unknown or other
  modified_base (309)..(309): a, c, t, g, unknown or other
  modified_base (367)..(367): a, c, t, g, unknown or other
  modified_base (388)..(388): a, c, t, g, unknown or other
  modified_base (460)..(460): a, c, t, g, unknown or other
  modified_base (470)..(470): a, c, t, g, unknown or other
  modified_base (487)..(487): a, c, t, g, unknown or other
tcagcatagtagtgcacgaccggtgctcgatttagtatctgatagttgggtttgggggggagaggagcccagcactggggattcccgaggtgtttccattcggtgatcagcactgaacacagaggactcaccatggagttttggctgagctgggttttcctgttgctatttcaaaaggtgtccactgtgagttcaactggtggagactggaggaggctggatccgagccgtggggggtccctgacgactctcctgtgcngtcctcgtgggttcagcatcagtaacgactacatcgaccgtcgggccccnccgacggctccgaggggtaaggggcgtgggagtgggtctcgagtttatagaaactagntggcaactacattaaacgttnttctgacgtcgtcggaacggtcccgttacaccctcacccgagacgacaccttacgaaactacgtatccgttntattaccctnacgagcacacactacgngacgacgtacgaccgaccgaccgtcctactaacttacgttcgtcgacgcgtacacgttcactctcgtctacgtacggttcggtaacggaacggaaccg

SEQ ID NO: 366270 - DNA, 746 bp, Homo sapiens
  misc_feature: GZ8MTXP01A2V85.10.38.D05.1.454.CMB.2.raw
  modified_base (382)..(382): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtggaggaggctggatccgaggccgtggggggtccctgacgactctcctgtgcacgcctcgtgggttcagcatcaagtaacgactacatcggacccgtcgggccccgccgacgggcctaccggagggggaagggggcgtagggacgtggggtctcgtagttaattaggaaacngacgtcggactactaactattaaactttactttcgtacgtaaccgttcccgggtagggtaaaccgggggtccccggttacccaacccctttcgaacccgaagggtaaccgtaaccctaaccctttaccccaaaacttaaaccctactttaccttacgttaacttaccccgtttacaaacctacttacggaccctaaacctaaacgtttccgtaaggaacgaacggttaacccgaacccggaaacccgtaacccggtacccttaaaccggtttaatttaacggttcggtcgacccggtgaaccttagttcggacctaaccgtctaacgaacgtttcgggacgggggtaacccaagggggtccccg

SEQ ID NO: 366271 - DNA, 569 bp, Homo sapiens
  misc_feature: GZ8MTXP01E1LM2.10.38.D05.1.454.CMB.2.raw
  modified_base (275)..(275): a, c, t, g, unknown or other
  modified_base (362)..(362): a, c, t, g, unknown or other
  modified_base (441)..(441): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaaggtgtccactgtgaggttcaactggtggagacgtggaggaggctggatccagccgtgggggtcctgagactctcctgtgcacgcctcgtgggtcagcancaagtaacgactacatcgaccgtcggccccgcgacggcctacggaggggacgggcgtgggaggtgggtctacgtagttatagaaacngactggacaactacattaattatctagactcggtaggaacggtccgtaccacccgtcacagacactactacaaacactntcgtatactctacactgtacacaataatcgtagacgtacgacgacgacgaccgacctacgtaattattgcgcgacacagttcgaccgttaacgctaacgtaagtccgggagggaaccgaagggccccg

SEQ ID NO: 366272 - DNA, 668 bp, Homo sapiens
  misc_feature: GZ8MTXP01EFYN3.10.38.D05.1.454.CMB.2.raw
  modified_base (270)..(270): a, c, t, g, unknown or other
  modified_base (379)..(379): a, c, t, g, unknown or other
  modified_base (603)..(603): a, c, t, g, unknown or other
tcagcatagtagtgcacgaccggtgctcgatttagtatctgataggttggggtttgggggggagaggagcccagcactgggattccgaggtgtttccattcggtgatcagcactgaacacagaggactcaccatggagttttggctgagtctgggttttccttgttgctatttcaaaggtgtccactgtgaggttcaacgtggtggagacgtggaggaggctggatccgagccgtgggggtccctgacgactctccgtgtcgcacgcctntgggttcagcatccagtaacgactaacagtgacccgtgggccccgcacggcctaccggacggggagggggcctggggtagtcggggtcctcgagtttataggaaaaccngtaactggacaactactattaacttattcgtcgaaccgttccgtacggaacggggtccggttccaaccccttcgtaccaacgacgtacctaaccttacccaaaactaactacttacctttagtaacttccttacactaactcgtactaactaatcctagagtacgtaccggaccgtaccgacgtaccctaaccgttaatttacgttcggacgccggtacaaacncgttcggaacctcggtaccctcgtaaaacggtttccgacgggggtccccgaagggggtaaccccg

SEQ ID NO: 366273 - DNA, 672 bp, Homo sapiens
  misc_feature: GZ8MTXP01AJAK0.10.38.D05.1.454.CMB.2.raw
  modified_base (396)..(396): a, c, t, g, unknown or other
  modified_base (513)..(513): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcgttgggttttccttgttgcttatttacaaaaggtgtccactgtgaggttcaacttggtggagacgtggaggaggcgtggactccgacggtccggtcggggggtccctgacgtacctctcctgtcgcacgtcctgtgggttcagcatacaaggtaaccgactacagtcgacccggtcgggccccgccgaggccgtaccggagggggagggcgtgggaggtgggtctacgtagtttagtacgaaacgngtagtcggtacaactactatttaattacttcgtacggtacccgttccggtaggggtaaccggggtccccgttacctaccccctcgtaccgaaggaccaacctacctaacaaacactntttcgttagtacttcttacatacgtcacactaatcgtagagacgtaccgacgaacccgcgtacctaacgttaattacgttcggacgcccgtaagtaacacgttcgaaaccgtcggttacctaagttaacggttcgggacgggccgttaacgggtccccg

SEQ ID NO: 366274 - DNA, 693 bp, Homo sapiens
  misc_feature: GZ8MTXP01DVVOY.10.38.D05.1.454.CMB.2.raw
  modified_base (273)..(273): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcancagtaacgactacatcgacctcgggccccgccgaggctccgaagggggaacgggggctgggagtggggtctacgtagtttactagaaaacagaacgtggactaactaactaattaacgtttaatttccgtagtaacccgttacccgggtaggggtaaaccggggtccccggggtttacctaaccccccgtcttacccgaaacggtaacgaaccctaacctttacccaaaactaacctattccttagttactcttacactagttcgactaactaactcgagaacgacgtcccgaaccgacaccccggtccctaaacccgttaatttaacgttcggtgacccgacggtaaccagttccggaaccctaaccggtacttaacgtaacgttccgggttacggggaaccccgaagggggaaccccg

SEQ ID NO: 366275 - DNA, 692 bp, Homo sapiens
  misc_feature: GZ8MTXP01EF4TB.10.38.D05.1.454.CMB.2.raw
  modified_base (248)..(248): a, c, t, g, unknown or other
  modified_base (325)..(325): a, c, t, g, unknown or other
  modified_base (431)..(431): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagccctcctccgcgtccgggtctcctggacagtcagtcaccatcctcctgcacgtggaaccagctagtgtacttttgtntacttaataactatcgtctctaggtaccagccaaccaccaaggccaaaacgccccctaaattcctttgtttgacgtnagtaacgcggtccctgacggtctccctgacttcggtctcgtccgcctacaagtctggaaccactcgttccctccgtcgaccgtctcgcgggtctccgagtctgagntggaggtctagtacttacaccgtgacgacggcgtaacttaagttaccgttaccggaacccgtaccccggtaaagggttagggggttcggtttcgggggacgggtaccgggggtacgtaaacgggtcggtaacccgggttccggttcggggttccgaacccgggtaccccgttaagggttccccgtttacccggccccccgttacgggttccccttaaccgtttcccgtttaccggtttcccccttaaccccgtttcccccg

SEQ ID NO: 366276 - DNA, 775 bp, Homo sapiens
  misc_feature: GZ8MTXP01D08OE.10.38.D05.1.454.CMB.2.raw
  modified_base (574)..(574): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttacaaaaggtgtccactgtgaggttcaactggtggagacgtggaggaggctggatccagccgtgggggtcctgagactctcctgtgcacgtcctgtcgggttcacgcatcgagtaacacgtacatcgaccgtcgggccccgacgtacgggcctaccggagggggaaacgggggtccgtgggtacgggttcgggtacttacggtaagtttaattaacggaaaactaggtaacgtcggactaacgtaactaatttaaactttaatttccgagtaaacccgtccgggttaacgggaaccgggggtcccgggttaccacccccttacgtacccgaaagaccggtaactaaccgttacccaaaacctaacctaacttcgtttaacgtaacttcctttaaccaaaccgtnttaaaccggctaaaacccgtaaatttccgtaagaaccggttacgtaaacccgggaacctaacccgaaaccggtccccttaaaaccgtttaatttaaacgttcggttacgggacctaacccggaattacggttaccgaacgttaaccccgtcgttaaccgttaacggttccggggaacggggtaaccgaaccggggtaaccg

SEQ ID NO: 366277 - DNA, 741 bp, Homo sapiens
  misc_feature: GZ8MTXP01CG9SL.10.38.D05.1.454.CMB.2.raw
  modified_base (325)..(325): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgctatttacaaaaggtgtccatgtgaggttcaacgtggtggagacgtggaggaggctggactccgagtccggtgggggtccctggacgtactctcctgtgcacgtccgtgtcgggttcagactatacaacgtaacgactacagtcgaccgtcgggccccncgacggtcgtaccggagggggaacgggcgtaggggacggttcggggtctacgtaaggtttagttaacgaaacgtaggtaaccgtagggtactaacttaactaagtttaaatttacgttcgtacgtaacccgttaccgggtacgggtaaccggggttccccggtttaccacccttaccgtacaaacggtactaacctaaccttaccaaaactaacgtacttcttacgttaactcttacactacgttacaacctacgtaaacgtctaagggaacgtacggtacccggaacgtaacccgtaccgtaccctaaaccttaagttggttacgtcggacggtaccctagttacgttcgaacccgtttaacgcccgttaagtaaccggttcggggaccggggcccggttaacggggtaaccccg

SEQ ID NO: 366278 - DNA, 751 bp, Homo sapiens
  misc_feature: GZ8MTXP01DV7EA.10.38.D05.1.454.CMB.2.raw
  modified_base (217)..(217): a, c, t, g, unknown or other
  modified_base (358)..(358): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgagggaagggctggagtgggtctcagttatgaaacngatggcactacattattatctgactccgtggaacgggccgttcaccctctccagacgacacttaccaaacactatcttgtatcttacacatcgacaacatctgagagtcgacacgacgcctacctattatgtgcgacgacngtcgaacctacgcttacgtaacgtttcgggtacgggggacccgtaaggggaccgtaccccggaacgggttcccaaccccggtttcccctaccccccgtaacgtacccccgtaccccgaaacccgggaaaccggggtccccctaacgggtttccccgggggttacccccccttttccccccgggttcgggcccccgttccccgttacgcccgttaccccggaaacgggggaccctaccccgtaccccggtaccgggaccgggaaacgtcccggaaacccgtcccggggcccgggtcccccgggttgggggccccttcggacccgggtttgggttaaaccccggaaacgggttaccccctttaccctttaccccgtaacctttaacgttaaccgg

SEQ ID NO: 366279 - DNA, 633 bp, Homo sapiens
  misc_feature: GZ8MTXP01DUL2Y.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctgggccccgccaggctccgaggggaaggggctgggagtggggtctcagttattagaaacagatggacactacataaattatctgactccgtagaacggggccggttcaccctactccagtacgactaccttaccaaactacctattccttgtaacttcttaccaacctattcgacctaactaactcctaggagtacgtaccggaacgtacccgtaaccgggccctaacccgttaatttaagtttcggttcgggcctaaccggaccttaaagttcggaaaccctaaccggtacttaacgtaaacttcgggttcgggggtaaccccaaggggggtaaccccg

SEQ ID NO: 366280 - DNA, 621 bp, Homo sapiens
  misc_feature: GZ8MTXP01DSK4U.10.38.D05.1.454.CMB.2.raw
  modified_base (487)..(487): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaggtgtccactgtgaggttcaactggtggagacgtggaggaggctggatccgagccgtgggggtccctgagactctcctgtgcacgcctctggggttcagcatcagtaacgactacatcgaccgtgggccccgaccagggcctaccgagggggaacgggggcgtagggaggttgggggtctcgagtttacgttagaaacgagagtcgggacactaactataaactttattccggactccggtagaacggggtcccggttacaccctctccagacgacacttaccaaactactattcttagtactccttacgaancttacgactaactaatcgagacgtacgtacgaaccgtacgaccgtacctaacttattaagttcgttcgcgacgaactagttacgacgttacgctacgtaacgttccggcggggaccgtaacgggccgtaacccg

SEQ ID NO: 366281 - DNA, 645 bp, Homo sapiens
  misc_feature: GZ8MTXP01CADTK.10.38.D05.1.454.CMB.2.raw
  modified_base (279)..(279): a, c, t, g, unknown or other
  modified_base (490)..(490): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtgggaggaggctggatccgagccgtgggggtccctgagactctcctgtgcagcctcgtgggttcagcancaagtaacgactacagtcgaccgtcgggccccgcgacgggcctaccggagggggaacgggggctgggaggtgggtctacgtagtttatagaaacagacgtcggactactaactattaaacttacttcgtcgtaccgtccggtacggaacggggtccccggttaccaccctctaccgaaggacaactaccttacccaaactaactattcctntaactcttacactatcgacaactaactcgtagacgacgtaccgaacgtaccgaccgtacctaattaacttagttcggtacgccgacgtaacttacgttcgaacctaaccggcttaacgagtttccgggacgggggtaaccgaagggggtaacccc

SEQ ID NO: 366282 - DNA, 715 bp, Homo sapiens
  misc_feature: GZ8MTXP01AIYWK.10.38.D05.1.454.CMB.2.raw
  modified_base (694)..(694): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccgaggccgtgggggtccctggagactctccgtgtcgctagcctcgtgggtcagcatcaagtaacgactacacgtcgaccgtgggccccgcacgggcctacggagggggaacgggggctagggacggtgggtctacgtagtttacgttagaaacgagacgttcggacaactactattaaactttacttcgtaggtacccttccgggtaggtaaaccggggtcccggttaccaccccttcgaccgaacgtacgtaacctaccgtttaacccaaaaccaacttacttcgtttaacggtacttacccttactaacctaacgtaccggtacaaactaaacgttcggaaccggtaagtaaccggtacccgaaacggtaacccggtacccgggtaaccctaaccgtttaattaacgttcggacgaccgtacgaacttacgcgttaaccgtaaccgtccctaagtaacgttcccggggngggaacccgaagggtccccgg

SEQ ID NO: 366283 - DNA, 671 bp, Homo sapiens
  misc_feature: GZ8MTXP01AEKDM.10.38.D05.1.454.CMB.2.raw
  modified_base (536)..(536): a, c, t, g, unknown or other
  modified_base (542)..(542): a, c, t, g, unknown or other
  modified_base (604)..(604): a, c, t, g, unknown or other
  modified_base (611)..(611): a, c, t, g, unknown or other
  modified_base (623)..(623): a, c, t, g, unknown or other
  modified_base (660)..(660): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagtttggctgagtcttgggttttccttgttgcttatttacaaaggtgtccatgtgagttcaacgtggtggagacgtggaggaggcgtggactccgacggtccggtcgggggtccctgacgtactctccgtgtcgctacgtcctcgttgggttcagtcatactaagtaacgactacagtcggacccgtcgggcccccgccgacgggtccgtaccggggagggggaacgggggtcgtagggggtacggttcggggttacttacggtaggtttaacgttaacggaaacagtaccgtcggactaactaactattaacgtttattcctgtaccgtccggtacgggtaaccgggttcccggtacctaccccgtctaccgacgtacgacctaaccttaccaactactnttactnttacttcctacacagtcacactaaagtgacgagacgtacgacaccgtacgcctacgtaattnttcggcncgtacaacgttnttacgttactcgactcctaaggttccgggacgggtcncggggtaaccc

SEQ ID NO: 366284 - DNA, 630 bp, Homo sapiens
  misc_feature: GZ8MTXP01A8BUX.10.38.D05.1.454.CMB.2.raw
  modified_base (354)..(354): a, c, t, g, unknown or other
  modified_base (382)..(382): a, c, t, g, unknown or other
  modified_base (499)..(499): a, c, t, g, unknown or other
  modified_base (594)..(594): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcgttgggttttccttgttgcttatttacaaaaggtgtccactgtgaggttcaacgtggtggagacgtgggaggaggctggatccgagccggtgggggtccctgagactctctgtgcacgtcctcgtgggttcacgcatacgaagtaaccgactacagtcgaccgtcgggccccgcgacggcctacggagggggaacggggcgtgggnggtcgggttctacgtagttatagaaacngactggacactaactattaattacttctgtaccgttccggtagggtaaccggtcccgttaccacccgttcacgaaggaactcctaccttacaaactcgtacttcctatactcgttanaacttgtacactaacgagtgagtacgacgaaccgacgtaccgtacctaccttaattgttacgttcggtcgcgacgtaacttcgacgttactaacnctaacggtacggtcgggacgggaaccgaacggtccg

SEQ ID NO: 366285 - DNA, 612 bp, Homo sapiens
  misc_feature: GZ8MTXP01EFHLH.10.38.D05.1.454.CMB.2.raw
  modified_base (308)..(308): a, c, t, g, unknown or other
  modified_base (481)..(481): a, c, t, g, unknown or other
  modified_base (503)..(503): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcagtcctgtgggtcagcatcaagtaacgactacagtcgacccgtcgggccccncgacggcctaccggaagggggaacggggcgtggggtaggtcggggttctacgtagtttaatagaaacgagactggacaatactattaattactcgtagtacgtccggtaggaaccgggtccgttcacccgtctacgagacgactaccttacaaaacactatctatactcttanacaggtcacagaacttcaggangtaccgacgaccacgtacctacgtaattattgcgcgacgaacttagttcgaaacttaaccggacttaacgaaactttcgggacggggtaacccgaagggggtaaccccg

SEQ ID NO: 366286 - DNA, 646 bp, Homo sapiens
  misc_feature: GZ8MTXP01EYUOW.10.38.D05.1.454.CMB.2.raw
  modified_base (306)..(306): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccnccaggctccgaggggaagggctgggagtcgggtctcgtagttatagaaacagactggacacgtaactattaaatttattctagtacgtccggtaggaaccggggttcccgtttaccctctaccagacgactaccttaccaaactaactacttcttagtacttccttacactatcggactaactatcgtagaagacgtacgaacgtaccacccggtacctaaccgttattaacgttcggttcgaccgttacgtaaacctagttaccggacccttaaccggcccttacgtaaaccgtttcgggacgggggttacccaacgggggttaaccgtaacccccggg

SEQ ID NO: 366287 - DNA, 712 bp, Homo sapiens
  misc_feature: GZ8MTXP01B6QII.10.38.D05.1.454.CMB.2.raw
  modified_base (509)..(509): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagtcttgggttttccttgttgcttatttacaaaaggtgtccactgtgaggttcaacgtggtggagacgtgggaggaggctggactccgagccggtgggggtccctgacgctctcctgtgcacgtcctgtggtcagcatcaagtaacgactacagtcgacccgtcgggccccgccgaggcctaccggagggggaacgggggctagggacggttcgggttctacgtaagtttaagttacggaaaacgtaggaaccgtcgggacctaacgttaaacctaagtttaaactttaacgtttcccgtacggtaaacccgttcccgggttaggggtaacccgggggtccccggttaccctaacccccgtttnacccgaaacgtacgaacctaacccttaacccaaaactaacctcttaccgttattacttccttacacctatcgacctaactaacttcgtaggaacgaggtaacccggaacgtacccgaccggtccctaacgttaatttcgttcgacgcgtacgaacttacgttcactccgacttctaaggtcgttacggggcgaaggggtcccg

SEQ ID NO: 366288 - DNA, 854 bp, Homo sapiens
  misc_feature: GZ8MTXP01ELNR1.10.38.D05.1.454.CMB.2.raw
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatacagtaacgactacatcgaccgtcggggccccgccgagggccgtacccggaagggggaaacggggggtcgtcgggggaaggttcgggggtaccttacgtaaaggtttaagttaggaaaacccgaggtaagtggactaaccttaaacaatttaatttaactttcgtacggtacccgttacccgggtacggggtaaaccggggggttcccccgggttttacccaaccccctttcccgtacccgaaacggggtaaaccgaaaccccttaaacccctttaaccccaaaaacctaaaccgttaactttaccccttttaaggtttaaacctttccccttttaaccgaaaccgttaaacgtttccgaacccaaaaccgttaaaattccccgttaagggaaaaccggtacgggttaaccccgggaaaccgtaaaccccggaaccccggggtaaccccttaaacccttttaaagtttaaacgttttgggtaaccgggtcccggaaccggttaacttacggttaacggaaacccttaaccggtacttaaccgttaaacggttttccgggttaacggggggaaccccgg

SEQ ID NO: 366289 - DNA, 591 bp, Homo sapiens
  misc_feature: GZ8MTXP01B21MF.10.38.D05.1.454.CMB.2.raw
  modified_base (259)..(259): a, c, t, g, unknown or other
  modified_base (266)..(266): a, c, t, g, unknown or other
  modified_base (277)..(277): a, c, t, g, unknown or other
  modified_base (365)..(365): a, c, t, g, unknown or other
  modified_base (368)..(368): a, c, t, g, unknown or other
  modified_base (448)..(448): a, c, t, g, unknown or other
  modified_base (552)..(552): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatgggagttttggctgagcttgggtttttccttgttgctatttcaaaaggtgtccactgtgaggttcaactggtggagactgggagggaggctggactccagccgtgggggtccctgagactctctgtncagcctntgggtcagcancaagtaacgactacactcgacccgtgggccccgccgaggcctccggagggggaaggggctgggaggtgggtctcgagttatagaaacnganggctacactattaattattctgacctcgaggaacgggtccgttccaccctctaccagacgactaccttacaaacgaactntcttgtactcttacgacagtcacaactaatcgtagacgtacgtacgaccgacgaccgcctaacctaatttacgttgtacgcgacgattacgttcgaccgtaacnctaactaacgtcggttccggggaaccgttgggtaacccg

SEQ ID NO: 366290 - DNA, 677 bp, Homo sapiens
  misc_feature: GZ8MTXP01AT6OR.10.38.D05.1.454.CMB.2.raw
  modified_base (174)..(174): a, c, t, g, unknown or other
  modified_base (217)..(217): a, c, t, g, unknown or other
  modified_base (392)..(392): a, c, t, g, unknown or other
  modified_base (407)..(407): a, c, t, g, unknown or other
tcagcatagtagtgcacgaccggtgctcgatttagtatctgatagttgggtttgggctgtgaggttcaactggtggagactggaggaggctggatccagcctgggggggtccctgagactctcctgtgcagcctctgggttcagcatcagtaacgactacatgacctgggcccncaggctccgagggagggctggagtggtctcagttatagaaacngatggcactactattattactctagacctcggtacggaacgggtcccgttacaccctctacagacacaccttacaaacaactatcttcgtactcctacaactatcgacaactatcgtagacgacggtaccgaacgacgaccgacctaacccgtatttatggtcgaccgacgaacngtcgtaaacgttacncctagtaacttcgggtcggggaccaggggaccgcccggaacggtccacccgtcccgtaccccacgtccctacccgaacgtaccggaaccctccggtcccggggttccccttcccccggtcggccccgtcccgtaccgtcccgtaccgaacgggccaccgacccctcggacggaacggacccaccggaccggttccgggaccccggtgggccgccgttccggtaacgtaccgtaaccggtaccctacccgttaccctaacgttaagtccgg

SEQ ID NO: 366291 - DNA, 762 bp, Homo sapiens
  misc_feature: GZ8MTXP01CW8LA.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgcttatttacaaaaggtgtccactgtgtaggttcaacgtggtggagacgtgggaggaggctggactccgacggccggtcggggggtccctggacgtacctctccgtgtgcacgcctcgtggtcagcatacaacgtaacgactacagtcgacccgtcggccccgaccgacggccgtaccgggagggggacgggggcgtaggggtaggttcggggttactacggttaagtttaagttaacggaaacgtaggtaacgtacgggtactaacgttaaacctaatttaaacgtttaactttcgttacggtaacccgttaccgggtaacggggtaaccggggtccccggtttaccacccccgttcgtaaccgaacggtaaccgtaacctaacccttaaacccaaaacttaccttaacgtttccgttaacgttacttaccttacaacctaggtaacgacctaaactacgtgtacgacgtacgtacccgaccgtaaccgacccggtacctaacttaattcgttcgtcggcctaacggcttaacgttcgttaacctaacggtccttaagtaccggttcgggacgggtaacccgaacggggtccccg

SEQ ID NO: 366292 - DNA, 730 bp, Homo sapiens
  misc_feature: GZ8MTXP01BV7PF.10.38.D05.1.454.CMB.2.raw
  modified_base (274)..(274): a, c, t, g, unknown or other
  modified_base (374)..(374): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctgtgggtcagcancaagtaacgactacatcgacccgtcgggccccgccgagggccgtccggaagggggaacgggggcgtgggtaggtcgggtctcgaaggtttatagaaacgnggtaacgtcgggactaaccgtaacatttaaacgtttactttccgtacggtaacccgttccccgggttagggtaaaccgggggtccccggttacctaacccccttcgtaccccgtaaagggaacccgtaacccttaacccctttaccaaaaaacccctaacttactttcccggtttagtaaccttcctttacaaactacgggttgaacctaaccaagtttccgaggacgtacggtaccgaaccgtaaccgaccggtacccttaacttaaatttgttgggcgacccgtaaccggtaacacgttccgacctaacgtcgttaaccgtaacggttccgggacggggtaacccgaaggggcc

SEQ ID NO: 366293 - DNA, 695 bp, Homo sapiens
  misc_feature: GZ8MTXP01EZ05G.10.38.D05.1.454.CMB.2.raw
  modified_base (683)..(683): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgacgactctcctgtgcagcctcgtgggttcagcatcaagtaacgactacagtcgaccgtcgggccccaccgaggcctccggaagggggaagggggtcgtaggggtaggtcggggttctacgtagtttaagttacgaaacagtacgtcggactaactaactattaaactttacttcgtacgtaacccgttacccgggttagggaaaccggggttcccggttacccaccccgttctaccgaacggactaaccctaccttacccaaaacctaacttcttacctttagtaccttacttaccaccaggttcactaaacctaagtcgtaggaacgtagtaacccgaacgtacccaccggtacccctaacttaagtttagttacggcgccgacgaacttagttcgaccgtaacgacttaacgtaaccggttcggacgggggtaacccngggggtaacccg

SEQ ID NO: 366294 - DNA, 734 bp, Homo sapiens
  misc_feature: GZ8MTXP01ED3GL.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgctatttacaaaggtgtccactgtgaggttcaacgtggtggagacgtggaggaggctggatccgacggtccgtcgggggtccctgacgactctcctgtgcacgtcctcgtgggttcagcatacgaagtaaccgactacacgtcggacccgtccgggccccgaccgacgggaccgtaccgggaagggggtaaagggggcgttagggggtaacggtttcgggggttacgtacgttaaggtttaagttaacggaaaacgtaggaacgtacggactaacttaactattaaacgtttacttcgtacgtaccgttaccggtagggtaaacccggggttccgttaccctacccctctacccgaaggaccacctaacctaccaaactaactattaccgttatactcttacaccagttcactactaacgtctagaacgtacgaaaccgccgaacgtaaccccggtctaaccgttaagtttacgttcggtacttccgacgtaaacttcgttacgttaacccgtaacgttcctaacgttaacggttcggttaccggtaaccgggaacgggtaaccccgg

SEQ ID NO: 366295 - DNA, 696 bp, Homo sapiens
  misc_feature: GZ8MTXP01BLFA4.10.38.D05.1.454.CMB.2.raw
  modified_base (518)..(518): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggactccgagccggtgggggtccctgagtactctccgtgtgcagtcctcgtgggttcagcatcgaacgtaacgactacacgtcggacccgtcgggccccgccgacgggccgtccggaagggggaacgggggcgtgggaggttcggggtctacgtaagtttagttaacggaaacgaggtacgtcggactaactaactattaactttaacgttctacggaccgttaccgggtacgggaacggggttccccgttaccaccccgttctacccgaagacgacctaaccttaccaaacgtaactnttctttagtacttccttacactgggtcacctaacaacgttcgtacgaagggtaccgtaccggaaaccgaccgacccggtacctaaacctttaagttagttcggcgacggacaacttacgttcgaccttaacggcttaacggtaaccgttcgggaccgggggtccaacgggggaacccg

SEQ ID NO: 366296 - DNA, 614 bp, Homo sapiens
  misc_feature: GZ8MTXP01A2GFQ.10.38.D05.1.454.CMB.2.raw
  modified_base (488)..(488): a, c, t, g, unknown or other
  modified_base (542)..(542): a, c, t, g, unknown or other
  modified_base (554)..(554): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgcttatttacaaaaggtgtccactgtgaggttcaacgtggtggagacgtggaggaggctggatccgaggccggtcgggggtccctgacgactctcctgtgcacgcctcgtgggttcagcatcaagtaacgactaacagtcgacccgtcgggccccgccgacggcctaccggagggggaacggggcgtgggaggttgggtctacgtagtttatagaaacagactcggacactactattaattatctgaccgtccggtaggaacgggtccgttccgaccctctacagtacacctacttaccaacactctctagttctccttacaacngtcactaaccattcgagacgacgtacgacaaccgtccgcctactaattattcgngccgacgtaacngttcttaccgtaacgtcgtaactaacgttcgggaccggggtaacgaacggggtaaccccg

SEQ ID NO: 366297 - DNA, 620 bp, Homo sapiens
  misc_feature: GZ8MTXP01BZQE9.10.38.D05.1.454.CMB.2.raw
  modified_base (358)..(358): a, c, t, g, unknown or other
  modified_base (564)..(564): a, c, t, g, unknown or other
tcagcatagtagtgcacgaccggtgctcgatttagtatctgataggttgggtttgggggggagaggagcccagcactgggattccgaggtgtttccattcggtgatcagcactgaacacagaggactcaccatggagttttggctgagcttgggttttccttgttgctatttacaaaaggtgtccatgtgaggttcaacgtggtggagacgtggaggaggctggatccgagccgtgggggtccctgacgactctcctgtgcacgcctcgtgggttcagcatcagtaacgactacatgacccgtgggccccgcaggcctccgagggggagggctggagtgggtctcgagttatgaaacngatcggacactaacattaaacgttacttcgtgtaacccgtcggtaggaacggggtcccgttccaccccttcaccgagtacgacctaccttacccaaacgaactacttcttagtaactcgttacacttacgtgactaacctaagtcctagaggtaccgacgtacgaacctccggcctaaccgtaatttcgttgcgttcggacgtaanacgttcgaacgttcgcctaacgtaacgttcggacgggggtcccaaggggtaacccg

SEQ ID NO: 366298 - DNA, 654 bp, Homo sapiens
  misc_feature: GZ8MTXP01EDZ9E.10.38.D05.1.454.CMB.2.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctgagactctcctgtgcagcctcgtgggttcagcatcagtaacgactacatcgaccgtgggccccgcaggcctccgagggggaagggctgggagtgggtctcgagttattagaaacagacgtggactacgtaactataaatttattcgtgtaccgttccggtggaaacggggtcccggttacaccccttcgtaccaggaacgaccaccgttaccaaaacctaactattaccttgtacttccttactacagggtctaccaacaaagttcctaggactacgggtaccggtaaaccgaaccggaacccggtacccacctttaaagtttacgttggtacgcggaccgtaacttagttcgttacccttaacggcctttaacgaactttcggacggggggtcccgaacggggtaacccgg

SEQ ID NO: 366299 - DNA, 676 bp, Homo sapiens
  misc_feature: GZ8MTXP01EZX3D.10.38.D05.1.454.CMB.2.raw
  modified_base (626)..(626): a, c, t, g, unknown or other
  modified_base (631)..(631): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtgggaggaggctggactccgacggccgtgggggtccctgacgactctcctgtgcacgtcctcgtgggttcagctatcaagtaaccgactaacagtcgacccgtcgggaccccgccgacggtccgtcccgggaagggggaacgggggccgtgggggaggttcggggttcctacgtaggtttaacttaggaaaaccgagtacgttacggactaactaactattaaatttacttcttacgaccgttccggtaggtaacggggtccccggttaccaccccttcgtacaacggacgtaaccactttaacccaaaaccaactacgttacctttagtacttactacgaaactgtacgactaacacttcgagacgtagtaccgaccgtacgtaccgacctacttaaattcgttgcgttcgacangttancccgtaagctaacgttagtccggttagggtcccgaagggaacccg

SEQ ID NO: 366300 - DNA, 707 bp, Homo sapiens
  misc_feature: GZ8MTXP01BI1IS.10.38.D05.1.454.CMB.2.raw
  modified_base (279)..(279): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggtttttccttgttgctatttcaaaaggtgtccatgtgaggttcaacgtggtggagacgtggaggaggctggatccgagccgtgggggtccctgagactctcctgtgcacgtcctgtgggttcagcancaagtaacgactaacagtacggacccgtccgggccccgaccgacgggaccgtccggaaggggggaacgggggcggtaggggtaggtgggggttccttacgtagtttaagttacggaaacgaggtacgtcggactaactactaagttaactttaacgttctacggtaacccgtccggtacgggtaaaccggggttcccgggttaccctaaccccgtctaccgaacggaactacctaacccttaacccaaacctaaacgttacttcctttagttaacttccttaactaacctaggttacgactaaactaagttactagggacgacggtaccgaacgaccgtaccgtaccctaacttaattacgttcgcgaccgataacgacttcggactaacgcctaagtacgtcggcgggggaacccaagggggaaccc

SEQ ID NO: 366301 - DNA, 632 bp, Homo sapiens
  misc_feature: GZ8MTXP01EP1I1.10.38.D05.1.454.CMB.2.raw
  modified_base (367)..(367): a, c, t, g, unknown or other
  modified_base (562)..(562): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaagtgtccactgtgaggttcaactggtggagactggaggaggctggatccagccgtgggggtcctgagctctcctgtgcagcctcgtgggttcagcatcaagtaacgactacatcgacccgtcgggccccgccaagggcctaccggaggggaaggggcgtggaggtgggtctcgtagtttagtagaaacagtacgnggactaactactattaaatttattcgtagaccgttaccggtcggaaacggggtccccgggttaccgtaacccctcccgttacgaacggtacgacctaacccgtttacccaaacctaactaacgttctcgttaacttccttacaccgtaatcggtactaccaatctagacgcgtacgacgacaccggcctaacgtnttagttcgtcgcgcgtaattgttcggacctaagcctaagtacgttacggcgggggccttaacggggcccg

SEQ ID NO: 366302 - DNA, 531 bp, Homo sapiens
  misc_feature: GZ8MTXP02G6SCT.10.38.D05.1.454.CMB.2.raw
  modified_base (292)..(292): a, c, t, g, unknown or other
  modified_base (307)..(307): a, c, t, g, unknown or other
  modified_base (351)..(351): a, c, t, g, unknown or other
  modified_base (385)..(385): a, c, t, g, unknown or other
  modified_base (393)..(393): a, c, t, g, unknown or other
  modified_base (398)..(398): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagtttttggctgagcgtggttttcgtgtaggctatttcaaaaggtgtccatgtgaggttcaactggtggagactgggaggaggctgggatccagcctgggggggtcccctgagactctcctgtgcagctctgggttcagcatcagtacgactacatgacnggccgccaggctccngggaaggggcgtgggagtggggtcgtcagtattgaacagatggnactacatattaattctgactcgtgaaggcggtcnccctctcncgaanacactacacacactctactatcttactacactacgacacactactagagacgtacgacgacgacgaccactacttattgtcgtcgacgacactacgtactaacgtactactacgtacgtcggacggacggacg

SEQ ID NO: 366303 - DNA, 548 bp, Homo sapiens
  misc_feature: GZ8MTXP02IRKWY.10.38.D05.1.454.CMB.2.raw
  modified_base (358)..(358): a, c, t, g, unknown or other
  modified_base (375)..(375): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccagcagtgactttgtgcttataactatgtctctggtaccagcaccaccaggcaaagcccccaaactcctttgttttgaggtcagtaagcggcctcaggacgtccctgatcggttctctgcctcaagtctggcaacncggcctcctgaccgtcnctgggctccagctgagatgagctgattacactgcaagcgactattacttcgacggacccccaagaggggttgtttcgggccggtacggggactaagggtcgaccggttccgtcgggtaccacgcccgaaggcctcgcccccgtcggtcaccgtctccgttccccacccttccc

SEQ ID NO: 366304 - DNA, 518 bp, Homo sapiens
  misc_feature: GZ8MTXP02F0J0X.10.38.D05.1.454.CMB.2.raw
  modified_base (350)..(350): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccagggctccgaggggaaggggctgggagtggggtctcagttatgaaacngatggcactacatattatctgactccgtgaagggccggttcaccctctccagagacacttccaaacacatcttgtatcttacacatgcacaatctagagagtcgacgacacggccactattatgcgcgcgacatgactaacgctacaattcgtcggggccagggaccg

SEQ ID NO: 366305 - DNA, 531 bp, Homo sapiens
  misc_feature: GZ8MTXP02IWVSF.10.38.D05.1.454.CMB.2.raw
  modified_base (265)..(265): a, c, t, g, unknown or other
  modified_base (351)..(351): a, c, t, g, unknown or other
tcagcatagtagtgcacgaccggtgctcgatttagtatctgatagttgggtttgggctgtgaggttcaactggtggagactggaggaggctggatccagcctggggggccctgagactctcctgtgcagcctctgggttcagcatcagtaacgactacatgacctgggcccgccaggctccagggaaggggctggagtgggtctcagttattgaaacagatggcactacatattatctgactccgtgaagggccggttcaccctntccagagacacttccaacaacatcttgtatcttcacatgcacaatctgagagtcgacgacacggccaccctattatgtgcgcgacntgactacgctcaatttcgtggggccaggggacgcccgaggtccacccgtctcccccagccctccaccaacgggcccatccggtccttccccctggtccgcccctgcctccaggacgcacctcccgagacgcacacgcggccctggcctgccctggtcaacggactacgttcccactacta

SEQ ID NO: 366306 - DNA, 529 bp, Homo sapiens
  misc_feature: GZ8MTXP02JRWWV.10.38.D05.1.454.CMB.2.raw
  modified_base (362)..(362): a, c, t, g, unknown or other
tcagcatagtagtgcacgaccggtgctcgatttagtatctgatagttgggtttggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgccccaaactccttgttttgaggtcagtaagcggcctcaggacgtccctgactcggttctctcgcctccaagtctggcaacncggcctcctgaccgtctcgtgggctccgagctgaggatgaggctgattactactgcagcgcatattcaacggccccaaagcgggttgttacgggcggcggactaagggtcgaccgtcgtcgggtcacgccgaaggctcgccctcggtcactctcgttcccgcctacc

SEQ ID NO: 366307 - DNA, 511 bp, Homo sapiens
  misc_feature: GZ8MTXP02GPRD7.10.38.D05.1.454.CMB.2.raw
  modified_base (414)..(414): a, c, t, g, unknown or other
  modified_base (423)..(423): a, c, t, g, unknown or other
  modified_base (430)..(430): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcaggcacagggtcctgggcccaggtctaggccctgactcagcctccctccgcgtccgggtctcctggacagtccatcaccatctcctgcactggacccacagttacattggtaaataatgaaatatgtctcctggtaccaacagtacccaggcaaagccccaaactgatgatttatgatgtcagtaatcgaccctcaggggtttctgatcgcttcttgcctcagtctgcacacgcctccctgaccatctctggctccagactgagacgaggctgattattatgcanctcacacanagcgcgngtcggtgggtggtcgggcggggacgacgacgtcgaccgtcgtacgcgacgaccgaacgcgtccgcccgtccgtctctctcg

SEQ ID NO: 366308 - DNA, 544 bp, Homo sapiens
  misc_feature: GZ8MTXP02HQCI1.10.38.D05.1.454.CMB.2.raw
  modified_base (301)..(301): a, c, t, g, unknown or other
  modified_base (407)..(407): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactggaggaggctggatccagccgtggggggtccctgagactctcctgtgcagcctctgggtcagcatcagtaacgactacatgacctgggccccncaggctccgaggggaaggggctggagtgggtctcgagttattgaaacagatggcactacattattattctgactccgtagaacggggtccgtcaccctctccaganacacttccaaacacattcttgtatcttcactatcgacactaagtctagagagtcgaacgactaccggcctaacttattattgcgcgacgacactgaactaacgctacgtaaattcgtacgggggccctaagggaccg

SEQ ID NO: 366309 - DNA, 532 bp, Homo sapiens
  misc_feature: GZ8MTXP02G2KMA.10.38.D05.1.454.CMB.2.raw
  modified_base (353)..(353): a, c, t, g, unknown or other
  modified_base (395)..(395): a, c, t, g, unknown or other
  modified_base (440)..(440): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttcctgttagctatttcaaaaggtgtccactgtgaggttcaactggtggagactggaggaggctgggatccagccgtggggggtccctgagactctcctgtgcagcctctgggttcagcatcagtaacgactacatgacctgggccccgccagggctccgaggggaaggggctggagtggggtctcagttattgaaacngatggcactacatattatctgactcgtgaaggcgtcaccctntccagacgacacttcccaaacaaccatcttgtatcttcactagtnacacactactagagagtacgacgacgacgacactacttatgtcgcgacgacactacgactaacgtactactactacgtcggacggacggacg

SEQ ID NO: 366310 - DNA, 518 bp, Homo sapiens
  misc_feature: GZ8MTXP02GNKGK.10.38.D05.1.454.CMB.2.raw
  modified_base (369)..(369): a, c, t, g, unknown or other
  modified_base (504)..(504): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctgggagtggggtctcagttatgaaacagatggcactacatattatcngactcgtgaagggccgttcaccctctccagagacacttcccaaacacatcttgatcttcacatgcacaatctagagagtcgacgacaaccggccaacctattattgtcgcgcgacatgactaacgctcaattcgnggggccagggaccg

SEQ ID NO: 366311 - DNA, 515 bp, Homo sapiens
  misc_feature: GZ8MTXP02GLEQB.10.38.D05.1.454.CMB.2.raw
  modified_base (219)..(219): a, c, t, g, unknown or other
  modified_base (369)..(369): a, c, t, g, unknown or other
  modified_base (382)..(382): a, c, t, g, unknown or other
  modified_base (397)..(397): a, c, t, g, unknown or other
  modified_base (429)..(429): a, c, t, g, unknown or other
  modified_base (448)..(448): a, c, t, g, unknown or other
  modified_base (453)..(453): a, c, t, g, unknown or other
  modified_base (460)..(460): a, c, t, g, unknown or other
  modified_base (464)..(464): a, c, t, g, unknown or other
  modified_base (474)..(474): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgagggaaggggctggagtgggtctcagttattgaaacngatggcactacatattatctgactcgtgaagggccgttcaccctctccagagacacttccaaacaacatcttgtatcttcacatgcacaatctgagagtcgacgacacggccaccctattatgtgcgcgacatgactacgctcaaattcnggggccagggacncccaggtcaccgtcncccagcctcacagggcccatcggtccttcccnggccgcctgctccaggacncaccncgagacncacncgccgtccgnggctcgccgtggtacaacggtacctacctacccactactag

SEQ ID NO: 366312 - DNA, 546 bp, Homo sapiens
  misc_feature: GZ8MTXP02H99TD.10.38.D05.1.454.CMB.2.raw
  modified_base (242)..(242): a, c, t, g, unknown or other
  modified_base (312)..(312): a, c, t, g, unknown or other
  modified_base (349)..(349): a, c, t, g, unknown or other
  modified_base (357)..(357): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaagggctgggagtgggtctcagttattgaaacagatggcactacatattattcngactccgtgaagggcccggttcaccctctccagagacacttccaacaacatcttgtatcttcacatgcanaatctgagagtcgacgacacggccaccctattattgngcgcgacntgactacgctcaattctcgggcccagggacgcccgaggtccacccgtcctccccagccctccaccgaacggccccagtccggtccttccccctggccgccctcgcctccgacggcgccacctccgagacgcacacgtccggccctcggggcctcgcctcggtcaacggactacctcccacttacctacg

SEQ ID NO: 366313 - DNA, 545 bp, Homo sapiens
  misc_feature: GZ8MTXP02HQLLD.10.38.D05.1.454.CMB.2.raw
  modified_base (398)..(398): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctcgggccccgccaggctccgaggggaggggctgggagtgggtctcgagttatagaaacagatggacactacatattatctgactcgtgaacgggccgttcaccctntccagacgacacttaccaaacaacattcttagtactcttcaacattcgacaacaatccagagagtcgacgacacggaccctaaccttattattgtcgcgacgacactgaactaacgctacaacttcgtcggggaccagggggacccg

SEQ ID NO: 366314 - DNA, 582 bp, Homo sapiens
  misc_feature: GZ8MTXP02GZEA0.10.38.D05.1.454.CMB.2.raw
  modified_base (303)..(303): a, c, t, g, unknown or other
  modified_base (353)..(353): a, c, t, g, unknown or other
  modified_base (405)..(405): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctgggccccnccaggcctccgaggggaaggggctgggagtgggtctcgagttatgaaacngatggacactacattattattctgactccgtagaacgggtccgttcaccctntcccagacgacctacttcccaaacacattcttagtacttcttacactatcgacaactaatcgtagaagaggtccgaacgaccgaccggaccctaacctttaattacgtttggcggccgacgactaagtcgtaacctaacgctacgtaaatttccggacgggggaccagggggacccg

SEQ ID NO: 366315 - DNA, 566 bp, Homo sapiens
  misc_feature: GZ8MTXP02H050V.10.38.D05.1.454.CMB.2.raw
  modified_base (346)..(346): a, c, t, g, unknown or other
  modified_base (510)..(510): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgcaggctccgaggggaaggggctggagtgggtctcagttatgaaacngatggcactacatattattctgacttccggtagaacggggcccgttacaccccgtctccaaggacgacaccttacccaaaacaaccattcttgtatccttacaacgattgacaacaatcctagacgagttccgaacacaccggcccaacttacttattcggtcncgtacgactatagacttaacgcttacaaacgtttcgacgggggcccaaggggaccg

SEQ ID NO: 366316 - DNA, 553 bp, Homo sapiens
  misc_feature: GZ8MTXP02F0LOI.10.38.D05.1.454.CMB.2.raw
  modified_base (459)..(459): a, c, t, g, unknown or other
  modified_base (499)..(499): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggcctccgaaggggaaggggcgtgggagtggggtctcgtagttattagaaaacagatggacactacatattaattctgactccggtagacggggtcccgttcaccctctaccagagaccacttaccaaacaacattcttagtactcttacacatnacaacaaagtctagagagtcgaacgacacggccacttatnttgtcgcgacgacatgaactaacgctacaagttcgacggggacccaggggaccg

SEQ ID NO: 366317 - DNA, 612 bp, Homo sapiens
  misc_feature: GZ8MTXP02H3N60.10.38.D05.1.454.CMB.2.raw
  modified_base (307)..(307): a, c, t, g, unknown or other
  modified_base (445)..(445): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgcttatttcaaaaggtgtccactgtgaggttcaactggtggagactgggaggaggctggatccagccgtgggggtccctgagactctcctgtgcagccctcgtgggtcagcatcaagtaaccgactacatcgacctcgggccccnccgaggcctcccgaggggaaggggctgggaggtgggtctcgagttattagaaacagagtggacaactactattattattctgtaactccgtagaacggggtcccgttccaccctctaccagtacgacactacccaaanaacattcctgttactcttacactaatcaccaaacaactcgttagaacgacggttaccgaaccgaaccaccgggtacccctaaaccttagtttaatttccggcgaccggacgactacgtacgaacctaacgacttaacgtacgttcgggacggggaccgaacgggccg

SEQ ID NO: 366318 - DNA, 444 bp, Homo sapiens
  misc_feature: GZ8MTXP02IGHIU.10.38.D05.1.454.CMB.2.raw
  modified_base (239)..(239): a, c, t, g, unknown or other
  modified_base (306)..(306): a, c, t, g, unknown or other
  modified_base (399)..(399): a, c, t, g, unknown or other
  modified_base (430)..(444): a, c, t, g, unknown or other
tcagcatagtagtgcacgaccggtgctcgatttagtatctgatagttgttggaagtgtctctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcgnggggccagggagcccaggcaccgtctccccagcctccaccaagggccccatccggtccttcccccgnggccgcccctgcctccgaggacgccaccctccgagacgcaccgacgccggccctggggctgcctggtacaaaggcctaccttcccactactangctggagcgggctggacaagggcacgatagnnnnnnnnnnnnnnn

SEQ ID NO: 366319 - DNA, 572 bp, Homo sapiens
  misc_feature: GZ8MTXP02GMGMS.10.38.D05.1.454.CMB.2.raw
  modified_base (221)..(221): a, c, t, g, unknown or other
  modified_base (268)..(268): a, c, t, g, unknown or other
  modified_base (346)..(346): a, c, t, g, unknown or other
  modified_base (354)..(354): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctggagtgggtctcagttattgaaacngatggcactacatattatctgactccgtgaagggccgttcaccctcnccagagacacttccaaacaacatcttgtatcttcacatgcacaatctgagagtcgacgacacggccaccctattatgngcgcgacntgactacgctacaatttcgtggggccagggacgcccgaaggtccaacccgtcctccccgagccctccaaccgaacgggccccagtccggtcccttccccgtggcccgccctcgcctccgaggcgccaacctccgaagacgcaccgacgccggcccgtcgggcctcgcccgtgggtaccaaacgggtaccctacctttacccccaacttacccttaacg

SEQ ID NO: 366320 - DNA, 563 bp, Homo sapiens
  misc_feature: GZ8MTXP02IL38U.10.38.D05.1.454.CMB.2.raw
  modified_base (301)..(301): a, c, t, g, unknown or other
  modified_base (348)..(348): a, c, t, g, unknown or other
  modified_base (397)..(397): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactggaggaggctggatccagccgtgggggtccctgagactctcctgtgcagcctctgggttcagcatcagtaacgactacatgacctgggccccncgaggctccgaggggagggctgggagtggggtctcagttatgaaacngatggcactacatattattctgactccgtagaacgggtccgtcaccctntccagacgacacttacccaaacaactacttcttagtactacttcacatcgacaactaattccgtagagtaacgtaccgaacgaccaccgggccctaaaccgtttattaactttggcgaccgacgtaccatcgactaacgctactactcggtcgggaccgaggcccg

SEQ ID NO: 366321 - DNA, 650 bp, Homo sapiens
  misc_feature: GZ8MTXP02JM92Y.10.38.D05.1.454.CMB.2.raw
  modified_base (320)..(320): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggggaggagcgtggactccgacgtccgggtcgggggtccctggacgtactcctcctgtcgcacgcctcgttggttcagctatcaagtaacgactacatcgaccgtcgggccccncgaggcctaccggaaggggaacgggcgtagggaggtcgggtctcgtagtttatagaaacgagtagtcggactactaactattatttacttcgtacgtaaccgttccggtagggaaccgggggttccccggtttaccctaacccccgttccgtacccgaaagggaaccgtaccctacccttaacccaaaacaacctattccgttatacttccttacactagtcaccaatacgtgtagagtacggtaccgaacgaccgaccggaccaacttattagttcgcgcgacgactagtcgaactcgcttactacgttcggcgggaccgaggggaccc

SEQ ID NO: 366322 - DNA, 548 bp, Homo sapiens
  misc_feature: GZ8MTXP02JR2GZ.10.38.D05.1.454.CMB.2.raw
  modified_base (317)..(317): a, c, t, g, unknown or other
  modified_base (360)..(360): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctgtaccagcaccaccaggcaaacgccccaaactccttgttttgagtcagtaacgcggccctnaggactccctgactcggttctctcgcctcaagtctggacaacncggcctccctgaccgtctcgtcgggctcccgaggctgagatgaggctgtattacactgcagcgcagtactcgacggaccccaaagcgggttgttcgggcggcggacgtaaggtcgaccgtccgtcgggtacacggcccgaagggtcctcgcccccgtcggtcctactctccgtttccccacccttccc

SEQ ID NO: 366323 - DNA, 525 bp, Homo sapiens
  misc_feature: GZ8MTXP02G9W3O.10.38.D05.1.454.CMB.2.raw
  modified_base (349)..(349): a, c, t, g, unknown or other
tcagcatagtagtgcacgaccggtgctcgatttagtatctgatagttggggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggccccgccaggctccgaggggaaggggctgggagtgggtctcagttattgaaacngatggcactacatattattctgactccgtgaacggggccgtcaccctctccagagacacttccaaacacatcttagtatcttcactatcgacacaatctagagagtcgacgacacgccaaccttattatgtcgcgacgacatcgactaacgctacattcgcgggggccagggaccg

SEQ ID NO: 366324 - DNA, 525 bp, Homo sapiens
  misc_feature: GZ8MTXP02FPB2C.10.38.D05.1.454.CMB.2.raw
  modified_base (300)..(300): a, c, t, g, unknown or other
  modified_base (370)..(370): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccnccaggctccgaggggaaggggctgggagtggggtctcagttatgaaacagatggcactacatattattcngactccgtgaacgggccggttcaccctctccagagacacttaccaaacacatcttgtatcttacacatgcacaatactgagagtcgacgacacgaccacctacttattgtgcgacgacatagactaacgctacacttcgtcgggacgacggacgg

SEQ ID NO: 366325 - DNA, 385 bp, Homo sapiens
  misc_feature: GZ8MTXP02I1MIY.10.38.D05.1.454.CMB.2.raw
  modified_base (383)..(385): a, c, t, g, unknown or other
tcagcatagtagtgcacgaccggtgctcgatttagtatctgatagttgggtttgggggaagaggaagactgacggtcctgccacaggtggtgctgggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaaggcccatcggtcttccccctggccgccctgctccaggagccacctccgagagcacagcggccctgggctgcctggtcaaggctactcccccactactatgctgagcggggctggcaaggcgcatagnnn

SEQ ID NO: 366326 - DNA, 553 bp, Homo sapiens
  misc_feature: GZ8MTXP02J2MLJ.10.38.D05.1.454.CMB.2.raw
  modified_base (349)..(349): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccagggctccgaggggaaggggctgggagtgggtctcagttatgaaacngactggcactacatattatctgactccgtgaacggggccgtttcaccctctccagacgactacttcccaacaacattcttagtatcttacactatgcacaagtctagagtagtccgacgaccacgggccctaaccttacttagttgcgcgacgacaagttcgaactaacggtctacgaactttcgacgggggccaggggacccg

SEQ ID NO: 366327 - DNA, 532 bp, Homo sapiens
  misc_feature: GZ8MTXP02GNSOF.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtggggtctcgagtttatgaaacagatggcactacatattattctgactccgtgaacggccggttcaccctctccagagacactccaacacatctgtatcttcacatcgacacaatctagagacgtcgaacgacacggcccaaccttattacttgtcgcgcgaccatcgaactaacgctacaagttcgcgggggaccagggaccg

SEQ ID NO: 366328 - DNA, 545 bp, Homo sapiens
  misc_feature: GZ8MTXP02JICJS.10.38.D05.1.454.CMB.2.raw
  modified_base (332)..(332): a, c, t, g, unknown or other
  modified_base (344)..(344): a, c, t, g, unknown or other
  modified_base (490)..(490): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggcccgccaggctccgaggggagggctggagtgggtctnagttatgaaacngatggcactacatattatctgactccgtgaacgggtccgttcaccctctccagacgacacttaccaaactaacattccttagtacttccttacactatcgacacaatctagacgagtcgacgacacggccaacgttattattgtcncgtacgacagtcgaacctaacgctacgtaacgttcgacggggaccaggggacccg

SEQ ID NO: 366329 - DNA, 547 bp, Homo sapiens
  misc_feature: GZ8MTXP02HFJII.10.38.D05.1.454.CMB.2.raw
  modified_base (445)..(445): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtggggtctcagttattgaaacagatggcactacatattattctgactccgtgaaggggtccggtcaccctctcccagacgacacttcccaaacaccatcttgactcttacactagtnacacaagtctagagagtcgaacgacacgcctaacctattattgcgcgacgacattcgaacctaacgcctactaaacgtttcgcgggggacccaggggacccg

SEQ ID NO: 366330 - DNA, 521 bp, Homo sapiens
  misc_feature: GZ8MTXP02F6L77.10.38.D05.1.454.CMB.2.raw
  modified_base (365)..(365): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctccaggggaaggggctgggagtggggtctcagttattgaaaccagatggcactacatnttatctgactccgtgaagggtccgttcaccctctccagagacacttccaaacaacatcttgtatcttacacatcgacacaatctagagagtcgaacgacacggaccaccgtattacttgtcgcgcgacatgactacgctacaattcgtggggaccg

SEQ ID NO: 366331 - DNA, 520 bp, Homo sapiens
  misc_feature: GZ8MTXP02FYZQU.10.38.D05.1.454.CMB.2.raw
  modified_base (371)..(371): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtggggtctcagttatgaaacagatggcactacatattattcngactccgtgaagggccgttcaccctctccagagacacttccaaacaacatcttgtatcttcacatgcacaatctgagagtcgacgacacggccactattattgtcgcgcgacatgactaacgctacaacttcgaggggcccagggaccg

SEQ ID NO: 366332 - DNA, 637 bp, Homo sapiens
  misc_feature: GZ8MTXP02J4EA0.10.38.D05.1.454.CMB.2.raw
  modified_base (519)..(519): a, c, t, g, unknown or other
  modified_base (522)..(522): a, c, t, g, unknown or other
  modified_base (525)..(525): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgctatttacaaaaggtgtccactgtgaggttcaacgtggtggagacgtggaggaggctggatccgaggccgtgggggtcctgagactctctgtgcagcctgtggtcagcatcagtaacgactacatcgaccgtcgggccccgccgacgggcctaccggaagggggaacggggtcgtaggggtagtcggggtctacgtagtttaataggaaacaggactcggactaacttaactattaatttacttccgtacggtaacccttcggtacgggaaccggggtccccgtttaccaccccgtactacccgagaaccgtacctaacccttacccaaactactacttcgttatactctcacntcncanatcgagacgtacgacgaacgaccacgtacccaatttacgttagtcgcggaccacgacacgttcgaaccttccgacttacgaacgtttccgggacgggacccgaggggccccg

SEQ ID NO: 366333 - DNA, 554 bp, Homo sapiens
  misc_feature: GZ8MTXP02HTLUU.10.38.D05.1.454.CMB.2.raw
  modified_base (402)..(402): a, c, t, g, unknown or other
  modified_base (439)..(439): a, c, t, g, unknown or other
tcagcatagtagtgcacgaccggtgctcgatttagtatctgatagttgggtttggggggagaggagcccagcactgggattccgaggtgtttccattcggtgatcagcattgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggccccgccaggcctccgaggggaaggggctgggagtggggtctcagttatagaaacagatggcactacattattattctgtactcgtgaacggggtccgttcacccctntccagacacacttacccaaacacattctagtatcttnaccgatcgacaacctaatctagacgaagtccgaacgacaccggccctaccttattacgttgcgcgccgactatcgactaacgctactaacttcgtcggggacctagggggacccg

SEQ ID NO: 366334 - DNA, 568 bp, Homo sapiens
  misc_feature: GZ8MTXP02G5C5F.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctcgggccccgccaggcctccggaggggaaggggcgtgggaggtgggtctcgagttattagaaacagagtggacactacattattattctgactccggtagaacggggtcccggttccaccctctcccaagacacaccttacccaaacaactattcttagtactcttacactatcgacaactaatctagagacgtcgacgacgaccgccaaccttattattgcgcgacgacatcgaactaacgctactaacgttcgacggggacccaggggacccg

SEQ ID NO: 366335 - DNA, 534 bp, Homo sapiens
  misc_feature: GZ8MTXP02JE4I4.10.38.D05.1.454.CMB.2.raw
  modified_base (243)..(243): a, c, t, g, unknown or other
  modified_base (263)..(263): a, c, t, g, unknown or other
  modified_base (368)..(368): a, c, t, g, unknown or other
  modified_base (483)..(483): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttatgaaacngatggcactacatattatcngactccgtgaagggccgttcaccctctccagagacacttccaaacaacatcttgatcttcacatgcacaatctgagagtcgacgacacggccacctattacttgngcgcgacatgactacgctcaattctggggccagggacgcccaggcaccgtctccccagccctccaccgaacggcccatccggtccttccccctggccgccctgcctccagggacnccaccgtccgacgcgccaacgcggccggccccgtgggcctcggccttcggg

SEQ ID NO: 366336 - DNA, 537 bp, Homo sapiens
  misc_feature: GZ8MTXP02H7RT3.10.38.D05.1.454.CMB.2.raw
  modified_base (348)..(348): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagcctggggggtccctgagactctcctgtgcagcctctgggttcagcatcagtaacgactacatgacctggccccgccaggctccgaggggaggggctgggagtggggtctcagttatgaaacngactggcactacatattattctgactccgtgaacggggccgttcacccctctccagagacacttacccaaacaactatcttagtactcttacacatcgacacaatctgagagtcgaacgacacggcccaaccttattattgtcgcgcgtacatcgaactaacgctacaacttcgcggggcacgggaccg

SEQ ID NO: 366337 - DNA, 530 bp, Homo sapiens
  misc_feature: GZ8MTXP02F6JVN.10.38.D05.1.454.CMB.2.raw
  modified_base (222)..(222): a, c, t, g, unknown or other
  modified_base (354)..(354): a, c, t, g, unknown or other
  modified_base (373)..(373): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcagttattgaaacngatggcactacatattatctgactccgtgaaggccgttcaccctctccagagacacttccaacaacatcttgtatcttcacatgcacaatctgagagtcgacgacacggccacccctattatgtgcgcgacntgactacgctcaatttcgnggggccagggacgcccaggtcaccgtctccccagccctcaccaggcccatccggtctcccctggccgccctgcctccacggacgccacctccgagcgacacacggccggccctggggcctcgccgttggacaacggacctacttccccactacctag

SEQ ID NO: 366338 - DNA, 617 bp, Homo sapiens
  misc_feature: GZ8MTXP02HP0P9.10.38.D05.1.454.CMB.2.raw
  modified_base (350)..(350): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggtcagcatcagtaacgactacatgacctgggccccgccaggctccgaggggaaggggctgggagtggggtctcagttattgaaacngatggcactacatattatctgactccgtgaagggtccgtcaccctctccagacgaccacttacccaaacactattcttagtatccttacacctattacgaccaactaacttctaggaacgacggttaccggaaaccgtaccgacccgggacccttaaacccgttatttaacgtttcggacggaccggtacgtaaccgattaccggaaccttaaccggccttacgtaaaacgtttccggacgggggtaccccgtaaagggggaccccg

SEQ ID NO: 366339 - DNA, 526 bp, Homo sapiens
  misc_feature: GZ8MTXP02JA2LS.10.38.D05.1.454.CMB.2.raw
  modified_base (350)..(350): a, c, t, g, unknown or other
  modified_base (457)..(457): a, c, t, g, unknown or other
  modified_base (481)..(481): a, c, t, g, unknown or other
  modified_base (484)..(484): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctggggccccgccaggctccgaggggaaggggctgggagtgggtctcagttatgaaacngatggcactacatattatctgactccgtagacgggtccgttcaccctctccagacgacacttaccaaacacattcttatactcttacacatcgacaactatctgagntcgacgacacgcacttatacttgngcncgacatcgaactcgctacgacttcgcggggaccagggacccg

SEQ ID NO: 366340 - DNA, 534 bp, Homo sapiens
  misc_feature: GZ8MTXP02GQUJJ.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgacctgggccccgcaggctccgaggggaagggctggagtgggtctcgagttatagaaacagatggcactacataattattctgactcgtagaacgggccgtcaccctctccagacacacttaccaaacacatcttgactcttacacatcgacactaaatctagagacgtcgacgacaccggccaacttattattgacgcgacgacatcgactaacgctactaagtcgtacggggcccaggggaccc

SEQ ID NO: 366341 - DNA, 528 bp, Homo sapiens
  misc_feature: GZ8MTXP02JL3A5.10.38.D05.1.454.CMB.2.raw
  modified_base (347)..(347): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgcaggctccaggggaaggggctggagtgggtctcgagttatgaaacngatggcactacatattatctgactcgtgaagggccgttcaccctctccagacgacacttccaaacacatcttagtactcttacactatcgacaacaatctagagacgtacgacgacacggccaacctattatgtacgcgacgacatcgactaacgctacaacttcgcggggccagggaccg

SEQ ID NO: 366342 - DNA, 529 bp, Homo sapiens
  misc_feature: GZ8MTXP02I9GNO.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggtcagcatcagtaacgactacatgacctggccccgcaggctccgagggagggctgggagtgggtctcagttatgaaacagatggcactacatattattctgactccgtagaacgggccgttcaccctctccagacgacacttccaaacacatccttgtactccttacactatcgacaactaatctagagagtcgacacgacgccacttattatgacgcgacgactatcgaactaacgctacaacgttcgcggggcccaggggacc

SEQ ID NO: 366343 - DNA, 559 bp, Homo sapiens
  misc_feature: GZ8MTXP02J3IU6.10.38.D05.1.454.CMB.2.raw
  modified_base (372)..(372): a, c, t, g, unknown or other
  modified_base (375)..(375): a, c, t, g, unknown or other
  modified_base (402)..(402): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccaggccgtggggggtccctgagactctcctgtgcagcctcgtgggttcagcatcagtaacgactacatgacctgggccccgccagggctccgaggggaaggggctgggagtgggtctcagttattgaaacagatggcactacatattntcngactccgtgaacgggccgttcaccctntcccagacgacaccttccaaacacattcttagtactcttacactagtgcaacaatctagagtacgtccgaacgaccaccggccaaccttattattcggcgcgacacagttacgacctaacgcctactaaacgtttcgcgggggacccaaggggcccg

SEQ ID NO: 366344 - DNA, 542 bp, Homo sapiens
  misc_feature: GZ8MTXP02HQK6O.10.38.D05.1.454.CMB.2.raw
  modified_base (299)..(299): a, c, t, g, unknown or other
  modified_base (363)..(363): a, c, t, g, unknown or other
  modified_base (448)..(448): a, c, t, g, unknown or other
  modified_base (453)..(453): a, c, t, g, unknown or other
  modified_base (495)..(495): a, c, t, g, unknown or other
  modified_base (505)..(505): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccagccgtgggggtccctgagactctcctgtgcagcctcgtgggtcagcatcagtaacgactacatcgactcgggcccnccagggctccgaggggaaggggctgggagtgggtctcgagttattagaaactagatggcactanattattaattctagactccggtgaacggggtccgttacacccctctccaagactacacttccaaacaaccaatcgttatatctanacatncaacaatcagagagcaccgacgaccgaccaacttatattgcncgacgaaccngtacactaacgactactactacgtcggacgacggacg

SEQ ID NO: 366345 - DNA, 522 bp, Homo sapiens
  misc_feature: GZ8MTXP02G4PIH.10.38.D05.1.454.CMB.2.raw
  modified_base (216)..(216): a, c, t, g, unknown or other
  modified_base (300)..(300): a, c, t, g, unknown or other
  modified_base (444)..(444): a, c, t, g, unknown or other
  modified_base (459)..(459): a, c, t, g, unknown or other
  modified_base (469)..(469): a, c, t, g, unknown or other
  modified_base (476)..(476): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacngatggcactacatattattctgactccgtgaacgggccgttcaccctctccagagacacttccaacacatcttgtatcttcacntgcacaatctgagagtcgacgacacggcctacctattatgtgcgcgacatcgactacgctcaattcgtggggcccaggggcgcccaggtccaccgtcctccccagcctcccaccgacggcccagtccggtcctccccgtggccnccctgcctccaggcncacctccganacgcacngccgtccgcggctcgcctgcgaacggactactcccactaccagtcg

SEQ ID NO: 366346 - DNA, 557 bp, Homo sapiens
  misc_feature: GZ8MTXP02JGCA6.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactggaggaggctggatccagccgtggggggtccctgagactctcctgtgcagcctcgtgggttcagcatcagtaacgactacatgacctggccccgccaggctccgaggggaaggggctggagtggggtctcgagttatgaaacagatggcactacatattattctgactccgtagaacgggtccgttcaccctctaccagacgaccacttacccaaacaacacttcttgacttcttaccactaatcgacaacaatctagagtacgcgaacgacaccgacctacttattagttgacgcgacgacactcgactaaccgctacctaagtccggtcggggaccaggggacccg

SEQ ID NO: 366347 - DNA, 532 bp, Homo sapiens
  misc_feature: GZ8MTXP02GB5FQ.10.38.D05.1.454.CMB.2.raw
  modified_base (287)..(287): a, c, t, g, unknown or other
  modified_base (301)..(301): a, c, t, g, unknown or other
  modified_base (347)..(347): a, c, t, g, unknown or other
  modified_base (514)..(514): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactanatgacctggccccncaggctccgaggggaggggctggagtgggtctcgagttatgaaacngactggcactacatattatctgactccgtgaacgggccgttcaccctctcaagacgacacttccaaacacatcttgactcttcacatcgcacaatctagagagtacgaacgacacggaccacttattattcgctcgcgtacagtcgaactcgactacgaacttccgnggggtacccaggggaccg

SEQ ID NO: 366348 - DNA, 567 bp, Homo sapiens
  misc_feature: GZ8MTXP02GVJGV.10.38.D05.1.454.CMB.2.raw
  modified_base (304)..(304): a, c, t, g, unknown or other
  modified_base (354)..(354): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctcgggccccnccaggctccgaggggaaggggctgggagtgggtctcgagttatagaaacngatggcactacattattatctgactccgtagaacggggtccgttcaccctctccaagacgaccacttacccaaacacattccttagtactcttacactatcgaccataatctagagacggtaccgaacgaccaccggaccctaaccttatttagtcgtacgcgacgactatcgactaacgctacgtaattccggacggggcccaaggggcccg

SEQ ID NO: 366349 - DNA, 521 bp, Homo sapiens
  misc_feature: GZ8MTXP02JF7HP.10.38.D05.1.454.CMB.2.raw
  modified_base (346)..(346): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccagccgtggggggtccctgagactctcctgtgcagcctctgggttcagcatcagtaacgactacatgacctgggccccgcaggctccgagggaggggctgggagtgggtctcagttatgaaacngatggcactacatattatctgactccgtgaagggccgttcaccctctccagacgacacttccaacacatcttgtactcttcgacatgcacaatctagagagtcgacgacaccgccaacctattatgtcgacgtcgacatcgactaacgctacaacttcgcggggaccaggggacc

SEQ ID NO: 366350 - DNA, 521 bp, Homo sapiens
  misc_feature: GZ8MTXP02G0NZG.10.38.D05.1.454.CMB.2.raw
  modified_base (300)..(300): a, c, t, g, unknown or other
  modified_base (352)..(352): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccnccagggctccgaggggaaggggctgggagtggggtctcgagttattgaaacngatggcactacatattattctgactccgtgaacgggtcgttcaccctctccagacgacacttccaaacacatctgtatcttacactatgcacaagtctgagagtcgacgacacggcaccttatactgtgacgcacatcgactaagctacacttgcgggaccaggggacc

SEQ ID NO: 366351 - DNA, 550 bp, Homo sapiens
  misc_feature: GZ8MTXP02HXRPP.10.38.D05.1.454.CMB.2.raw
  modified_base (350)..(350): a, c, t, g, unknown or other
  modified_base (403)..(403): a, c, t, g, unknown or other
  modified_base (410)..(410): a, c, t, g, unknown or other
  modified_base (421)..(421): a, c, t, g, unknown or other
  modified_base (439)..(439): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctgggagtgggtctcagttatagaaacngatggcactacatattattctgtactccggtagaacggggtccgttcaccctntccaganacactccaaanacatcttgtatcttacanattgcacaatctagagagtacgacgacacggacccaaccttattagttggtcgacgaccgacatacgaccttaacgcctacaagtttccgagggggacccaggggaacccg

SEQ ID NO: 366352 - DNA, 644 bp, Homo sapiens
  misc_feature: GZ8MTXP02HPGMM.10.38.D05.1.454.CMB.2.raw
  modified_base (639)..(639): a, c, t, g, unknown or other
tcagcatagtagtgcacgaccggtgctcgatttagtatctgatagttgggtttggggggagaggagcccagcactgggattccgaggtgtttccattcggtgatcagcactgaaaacagaggactcaccatggagttttggctgagctgggttttccttgttgctatttcaaaaggtgtccactgtgaggttcaactggtggagactgggaggaggctggatccagccgtgggggtccctgagactctcctgtgcagcctcgtgggttcagcatcaagtaaacgactacatcgaccgtcgggccccgccgaggcctaccggaaggggggaacggggcgtaggggaggttcggggtctcgtagttagttagaaacagatcggacaactacattattattctgtacctccggtaggaacggggtcccgttacaccctctaccagacgacctaccttaccaaaacgtaactattcgtttagtaacttccttacactagtacaccctaataactcgtaaggacgtaacgtacccggaacgaaccgaccggcccctaaaacttagttttattgggacgccgaccgaactagtacgaacctacggaacttacgaaagtttccgagggggcccaagggggaacccnccccg

SEQ ID NO: 366353 - DNA, 517 bp, Homo sapiens
  misc_feature: GZ8MTXP02F02X6.10.38.D05.1.454.CMB.2.raw
  modified_base (501)..(501): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctggccccgccaggctccgagggaaggggctgggagtggggtctcagttatgaaacagatggcactacatattattctgactccgtgaacgggccgttcaccctctccagagacacttcaacacatctgtatcttcacatgcacaagtctgagagtcgacgacacggccaacctattattgtcgcgcgacatgactaacgctacaacttcncggggaccagggaccg

SEQ ID NO: 366354 - DNA, 567 bp, Homo sapiens
  misc_feature: GZ8MTXP02IQ2A0.10.38.D05.1.454.CMB.2.raw
  modified_base (266)..(266): a, c, t, g, unknown or other
  modified_base (353)..(353): a, c, t, g, unknown or other
tcagcatagtagtgcacgaccggtgctcgatttagtatctgatagttgggtttgggctgtgaggttcaactggtagagactggaggaggctggatccagcctggggggtccctgagactctcctgtgcagcctctgggttcagcatcagtaacgactacatgacctgggcccgccaggctccgaggggaagggctggagtgggtctcagttattgaaacagatggcactacatattattctgactcgtgaagggccgttcacctcnccagagacacttccaaacaacatcttgtatcttcacatgcacaatctgagagtcgacgacacggccaccttattattgtgcgcgacntcgactacgctacaagttcgtgggccagggacgcccgaggtccacccgtcctcccccgacgtccctcccaccgacgggccccagttccgtcccttcccccgcggtccgccccctcgcctccgacggacgccacccgtccgacgacgccaacgcggtccggcccgtcggggcctcgccgtcggtacaacggtacctaccttaccccactactacg

SEQ ID NO: 366355 - DNA, 612 bp, Homo sapiens
  misc_feature: GZ8MTXP02HXVF2.10.38.D05.1.454.CMB.2.raw
  modified_base (177)..(177): a, c, t, g, unknown or other
  modified_base (284)..(284): a, c, t, g, unknown or other
  modified_base (310)..(310): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggtttcgtgtagctattacaaaaggtntccatgtgaggttcaactggtggagactggaggaggctggatccagccgtggggggtccctgagactctctgtgcagctcctgggttcacatcagtaacgactacancgacgcggccgcgcgcgcgaggaggngtggtggtggtcgtcgtagttagtagaagagagtcgacactactattattattactcgtacgtacgtacggtacgggtaccgttaccgtaccctcctaccacgacgtactacctaccaacaactacttacttacgtacttactactactactacgtactaactaactacgtacgtacgtacgtaccgaaccgaaccgaaccgtaccgtacttaacttacgttacgtacgtaccgtacgtacgtacgtacgtaaccgtacgtaacgtacgtaacgtacggtacggaccggacggaccggaccg

SEQ ID NO: 366356 - DNA, 566 bp, Homo sapiens
  misc_feature: GZ8MTXP02JU62W.10.38.D05.1.454.CMB.2.raw
  modified_base (270)..(270): a, c, t, g, unknown or other
  modified_base (356)..(356): a, c, t, g, unknown or other
  modified_base (373)..(373): a, c, t, g, unknown or other
  modified_base (387)..(387): a, c, t, g, unknown or other
  modified_base (472)..(472): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccaggggaaggggctggagtgggtctcagttattgaaacagatggcactacattattattctgactccgtgaacgggccggttcaccctntccagagacacttccaacaacatcttgtatcttcacatgcacaatctgagagtcgacgacacggcacccctattatgtgcgcgacntgactacgctcaattcnggggccaggggacncccgaggtcacccgtctccccagccctccaccaagggcccatccggtccttcccccgtggcccgccctgacctccgacgggaccncccaccgtccgacgacgccgacgaccggccggcccgtcggcctcgcccgtaaggtaccgaaacggtacccttacccttccccgaacttactacg

SEQ ID NO: 366357 - DNA, 525 bp, Homo sapiens
  misc_feature: GZ8MTXP02IUQ33.10.38.D05.1.454.CMB.2.raw
  modified_base (350)..(350): a, c, t, g, unknown or other
  modified_base (404)..(404): a, c, t, g, unknown or other
  modified_base (415)..(415): a, c, t, g, unknown or other
  modified_base (478)..(478): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctgggagtgggtctcgagttatgaaacngactggcactacatattatctgactccgtgaacgggcgttcaccctctccaganacacttccaanacatcttagatcttacactatgcacaatctgagagtcgacgacacggccacttattattgtcncgacgacatcgactaacgctactaacgttcgacggggccagggaccg

SEQ ID NO: 366358 - DNA, 518 bp, Homo sapiens
  misc_feature: GZ8MTXP02JL8L5.10.38.D05.1.454.CMB.2.raw
  modified_base (348)..(348): a, c, t, g, unknown or other
  modified_base (431)..(431): a, c, t, g, unknown or other
  modified_base (437)..(437): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattttcaaaaaggtgtccactgtgaggttcaactggtggagactggaggaggctggatccagcctggggggtccctgagactctcctgtgcagcctctgggttcagcatcagtaacgactacatgacctgggccccgcaggctccaggggaaggggctggagtggggtctcagttatgaaacngatggcactacatattatctgactccgtgaagggccgttcaccctctccagacgacacttccaaacaacatcttgtatcttanactatncacaatactgagagtcgacgacacggaccacctacttattgtgcgcgacactgacaacgctcactactcggcgacggacgg

SEQ ID NO: 366359 - DNA, 544 bp, Homo sapiens
  misc_feature: GZ8MTXP02HD4W6.10.38.D05.1.454.CMB.2.raw
  modified_base (218)..(218): a, c, t, g, unknown or other
  modified_base (342)..(342): a, c, t, g, unknown or other
  modified_base (350)..(350): a, c, t, g, unknown or other
  modified_base (465)..(465): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttattgaaacngatggcactacatattatctgactccgtgaagggccgttcaccctctccagagacacttccaacaacatcttgtatcttcacatgcacaatctgagagtcgacgacacggccaccctattatgngcgcgacntgactacgctacaattcgtggggccagggacgcccaggtccacccgtctccccagccctccaccgaacgggccccatccggtccttcccccgtggccgccctcgcctccaggacnccacctccgagacgcacacggccggcccgtcgggcctcggccctgggtcaaacggtacctaccttccccacttactacg

SEQ ID NO: 366360 - DNA, 569 bp, Homo sapiens
  misc_feature: GZ8MTXP02JTA60.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttccttgttgctatttcaaaaggtgtccactgtgaggttcaactggtggagactggaggaggctgggatccagccgtggggggtccctgagactctcctgtgcagcctctgggttcagcatcagtaacgactacatgacctcgggccccgccgaggcctccgaggggaaggggcgtgggagtgggtctcgagttatagaaacagagtggacactacattattatctgactccggtagaacggggtcccgttccaccctctacccgagacgacctaccttacccaaacaactacttctttagtatccttacactatcgctaacaatctagagacgtcgacgacgaccgccaaccgttattagtgcgcgctacatcgactaacgctacgaacttccgtacggggcccaaggggcccg

SEQ ID NO: 366361 - DNA, 594 bp, Homo sapiens
  misc_feature: GZ8MTXP02I9HPI.10.38.D05.1.454.CMB.2.raw
  modified_base (362)..(362): a, c, t, g, unknown or other
  modified_base (394)..(394): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccagcagtgactttgtgcttataactatgtctctggtaccagcaccacccaggccaaacgcccccaaactcctttgttttgaggtcagtaagcggcctcgaggagtccctgactcggtctctcgcctcaagtctggacacncgcctcctgaccgtctctggctcgagctgagntgagctgtattactactgacagcgactatacttccgaacggtacccccaaagtacggggttggtttcgggaccgggtacgggaacgttaaagggtcggtaacccggttcgtacggggtccaacggtcccgaaacggtccgttacccggcccccgttcggtacctaccgttccgttaccggttcccccgtaccctttcccc

SEQ ID NO: 366362 - DNA, 614 bp, Homo sapiens
  misc_feature: GZ8MTXP02IHY3S.10.38.D05.1.454.CMB.2.raw
  modified_base (377)..(377): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacatcgacctgggccccgccagggcctccgaggggaaggggctgggaggtgggtctcgtagttatagaaacagatggcactacatattattcngactcgagacgggtccgtcaccctctcagacacacttacccaaacaacattcttagtacttccttacaactattcgacaactaactcgtagaacgacggtaccgaaccgaaccgaaccgggacccctaaaccctttagttacgtttcggcgtaccggccgaaactacgttcggaaaccttaaccggtcctaccgttaaaacgtttccgtaccggggggacccctaagggggaccccg

SEQ ID NO: 366363 - DNA, 541 bp, Homo sapiens
  misc_feature: GZ8MTXP02HJJTU.10.38.D05.1.454.CMB.2.raw
  modified_base (360)..(360): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccacccaggcaaacgccccaaactccttgttttgaggtcagtaagcggcctcaggagtccctgatcggtctctcgcctcaagtctggcaacncggcctccctgacccgtctcgtgggcctccgaggcctgacggatgaggctgattacactgcagcgctatattcacggtccccaacgagggttgtttcgggcggcgggacgtaagggtcgaccgtcgtcgggtcacgcccgaacggctcgccccgtcggtccactctcgttcccaccctccc

SEQ ID NO: 366364 - DNA, 536 bp, Homo sapiens
  misc_feature: GZ8MTXP02JKWWP.10.38.D05.1.454.CMB.2.raw
  modified_base (351)..(351): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctgggagtgggtctcagttatgaaacngatggcactacatattattctgactccgtgaacggggtccgttcaccctctccagacgacacttccaaacacatccttgtatcttacacatgcacaatctgacgagtcgaacgacacggcccaccgtattacttggtcgacgcgacactgactaacgctacgaacttcgcggggaccagggaccg

SEQ ID NO: 366365 - DNA, 584 bp, Homo sapiens
  misc_feature: GZ8MTXP02HZGUB.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggtcagcatcagtaacgactacatgacctgggccccgccaggctccgaggggaagggctggagtgggtctcgagttatagaaacagatggacactacattattattctgacttccgtaggaacgggtcccggttacaccccgtctacccaaggacacctaccttacccaaaacaacctattccttagtactccttacactattcgaccaacaatctagacgacgtccgacgaaccgacggcctaaccttattagtttcgcgccgcgtaacacgttagacctaacgctactaacgttcggtcggggacccagggggaccccg

SEQ ID NO: 366366 - DNA, 641 bp, Homo sapiens
  misc_feature: GZ8MTXP02GWE6U.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatgacctgggccccgcaggctccgagggaggggctgggagtggggtctctagttattagaaacagactgggactactaactattattattctgtaacctccggtaggaacgggggtcccggtttccaacccccgttcctacccgaggtacgaaccctacctttaccccaaaactaaacctaacttcgtttagtaacttcctttaccaactaacttcggacctaaacctaattccgtaggaacgtacggtaccgaaaccgaccgaccggaccctaacccttatttacttggtacgccgacgaactactcgtactaaccgctacctaagttccgtacggggacccgtaggggacccg

SEQ ID NO: 366367 - DNA, 584 bp, Homo sapiens
  misc_feature: GZ8MTXP02GJL9B.10.38.D05.1.454.CMB.2.raw
  modified_base (221)..(221): a, c, t, g, unknown or other
  modified_base (250)..(250): a, c, t, g, unknown or other
  modified_base (268)..(268): a, c, t, g, unknown or other
  modified_base (355)..(355): a, c, t, g, unknown or other
  modified_base (373)..(373): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctggagtgggtctcagttattgaaacngatggcactacatattattctgactccgngaagggccgttcaccctnccagacgacacttccaaacaacatcttgtatcttcacatgacacaatctgagagtcgacgacacggccaccctattatgtgcgcacntgactacgctcaattcgnggggccaggggacgcccgagggtccacccgtccctacccccgacgcccctaccgacccgaacgggcccctaacgtccggtaccctttcccccgtggcccgcccctcgacctccgacggacgcccaccgtccgacgacgcaccgacggcccggcccgtcggggcctcggcccgtaacgggtacaacggtacctaccttcccaacttactacg

SEQ ID NO: 366368 - DNA, 528 bp, Homo sapiens
  misc_feature: GZ8MTXP02HFZ1L.10.38.D05.1.454.CMB.2.raw
  modified_base (350)..(350): a, c, t, g, unknown or other
  modified_base (459)..(459): a, c, t, g, unknown or other
  modified_base (491)..(491): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggggttttcctgttgctattttcaaaaggtgtccactgtgaggttcaactggtggagactggaggaggctggatccagcctggggggtccctgagactctcctgtgcagcctctgggttcagcatcagtaacgactacatgacctgggccccgccagggctccgaggggaaggggctgggagtgggtctcagttatgaaacngatggcactacatattattctgactccgtgaacggggtccgttcaccctctccagacgacacttccaacacatcttagtactcttacactatgtacacaagtctgaagngtacgacgacacggccacctattactgtcgcncgacatgactcgctcgaacttcgcgggccagggaccg

SEQ ID NO: 366369 - DNA, 535 bp, Homo sapiens
  misc_feature: GZ8MTXP02GJS87.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtgggtctcgagttatgaaacagatggcactacatattattctgactccgtagagggtccgttcaccctctccagagacactccaaacacatcttgtatcttacacatcgcacaatctgagagtcgaacgacacggccaaccgtattacgttgtcgcgacgacactcgactaacgctacaaactttcgcggggaccaggggaacccg

SEQ ID NO: 366370 - DNA, 686 bp, Homo sapiens
  misc_feature: GZ8MTXP02G70XP.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgacgactctcctgtgcacgcctcgtggtcagcatcaagtaacgactacagtcgaccgtcgggccccgccgacgggtccgtaccggaagggggaacggggcgtaggggtacgggttcggggttcctacgtaaggtttaagttaacggaaaacgtaggtacgtacgggacctaactaactaatttaatttacttcgtacgtaccgttccggtaggggtaaccggggtcccggttaccaccccgttctaccgaacggtaaccgaacctacccttaacccaaaactaactacttacgttatacttcttacactagtcgacaactatcgtagacgtacgacgaccgacgaccgtacctaacgtttattacgttcgcggtacgaccgtactacgtacgtaaacctcgtacctaacgtaacgttccgggacggggacccgaacgggaccccgg

SEQ ID NO: 366371 - DNA, 574 bp, Homo sapiens
  misc_feature: GZ8MTXP02JFDN2.10.38.D05.1.454.CMB.2.raw
  modified_base (318)..(318): a, c, t, g, unknown or other
  modified_base (358)..(358): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccaccaggcaaacgccccaaactccttgttttgagtcagtagcggcctnaggactcctgatcggttctctcgcctcagtctggacaacnccggcctcccgtgacccgtctcgtcgggcctccgaggctggaggatggagctagtattactactgcaggcgactatacttacacggtaccccaaagtaggggttgtttacgggcgggtacgggacgtaagggtcgacccggttcgcgggtcacggtcccgaacgggtcctaccggcccccgtcggtcctaccgtccgtccgttccccaccttcccc

SEQ ID NO: 366372 - DNA, 518 bp, Homo sapiens
  misc_feature: GZ8MTXP02FURWL.10.38.D05.1.454.CMB.2.raw
  modified_base (518)..(518): a, c, t, g, unknown or other
tcagcatagtagtgcacgaccggtgctcgatttagtatctgatagttgggtttgggggaagaggaagactgagggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctatattgtgcgcgacatgactacgctcaattcgtggggccaggggagcccaggtcacccgtctccccagcctccaccaagggcccatcccggtccttccccctggcccgccctgcctcccaggacgccaccctccgagacgccacagccggccctgggctgcctggtcaaggctactcccactactatgcctgagcggctggcacggcgcatagn

SEQ ID NO: 366373 - DNA, 531 bp, Homo sapiens
  misc_feature: GZ8MTXP02F18HP.10.38.D05.1.454.CMB.2.raw
  modified_base (300)..(300): a, c, t, g, unknown or other
  modified_base (348)..(348): a, c, t, g, unknown or other
  modified_base (394)..(394): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccncaggctccgaggggaaggggctggagtgggtctcgagttatagaaacngatggcactacatattatctgactcgtgacgggccgttcaccctcnccagagacacttccaaacacatcttgtatcttacactatcgcactaatctagagacgtcgaacgacaccggccctaactattattgcgtcgacgacactcgactaacgctacaacttcgtcgggggaccagggaccg

SEQ ID NO: 366374 - DNA, 631 bp, Homo sapiens
  misc_feature: GZ8MTXP02JA8FT.10.38.D05.1.454.CMB.2.raw
  modified_base (303)..(303): a, c, t, g, unknown or other
  modified_base (351)..(351): a, c, t, g, unknown or other
  modified_base (458)..(458): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctgagactctcctgtgcagcctctgggttcagcatcagtaacgactacatgacctgggccccnccaggctccgaggggaggggctggaggtgggtctcagtttatgaaacngatggcactacattattatctgaccttccggtaggaacggggtccggttaccaccctctaccagacgacaccttaccaaacaccattcgttatacttcttacaactnttacgacaaactaattcgtagaacgtacggtccgaaaacgacccgaccgggacccctaaaacctttacgtttaagtttcggtcggtaccggaccgtaaccgtattaccggaaacctaaccggtaccttacgtaaaacggtttcgtacggggggacccctaagggggaaccccg

SEQ ID NO: 366375 - DNA, 599 bp, Homo sapiens
  misc_feature: GZ8MTXP02I3H7V.10.38.D05.1.454.CMB.2.raw
  modified_base (221)..(221): a, c, t, g, unknown or other
  modified_base (241)..(241): a, c, t, g, unknown or other
  modified_base (264)..(264): a, c, t, g, unknown or other
  modified_base (318)..(318): a, c, t, g, unknown or other
  modified_base (348)..(348): a, c, t, g, unknown or other
  modified_base (354)..(354): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctggagtgggtctcagttattgaaacngatggcactacatattatcngactcgtgagggccgttcacctntccagacgacactccaacaacatcttagtatcttcaacatgacacaatctaganagtcgacgacacggccaacctattatgtancgcaantcgactacgctactaagttcgacggggaccagggaccacccgaggtcccaccgtccctaccccgacgaccctacccgaacgaaccggtccctacgttcccggttacccttcccccgcggtcccgcccgtcgcccgtaccgacggacacccaaccgtccgaaggaccgacgaccgaccggcccgggtccgtcgggccgtcgccgtaacggtacgaaacgtaccctacctaccctaacgttactacg

SEQ ID NO: 366376 - DNA, 650 bp, Homo sapiens
  misc_feature: GZ8MTXP02I2E9S.10.38.D05.1.454.CMB.2.raw
  modified_base (256)..(256): a, c, t, g, unknown or other
  modified_base (337)..(337): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcngcctctgggttcagcatcagtaacgactacatcgacctcgggccccgccagggcctaccggaggggaacggggcgtagggnggttggggtctacgtaagtttaagttacgaaaacaggacgtggacctaactaactaattaatttattcgtagtacctccggtaggaacgggtcccggttccacccctctcccagacgaaccaccttacccaaacaacacttctagttactccttaccactatcgacaacaatcctagagacggtacgaacgtacgaccggacctaacccttagttactttcggacgtaccgggaccaacgtaactcggtaaacctaaccggtaccttaaccgtaaacgttccggtacgggggaccccgaaggggaacccccgg

SEQ ID NO: 366377 - DNA, 578 bp, Homo sapiens
  misc_feature: GZ8MTXP02GT5GB.10.38.D05.1.454.CMB.2.raw
  modified_base (302)..(302): a, c, t, g, unknown or other
  modified_base (355)..(355): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcagtaacgactacatcgacctcgggccccnccaggcctccgaggggaaggggctgggaggtgggtctcgtagttatagaaacngatggacactacattattatctgactccgtagaacgggtccgttcaccctctaccagacgaccaccttaccaaacactattcttagtacttcttacactatcgacaactaatcctagacgacgtaccgaaccgacgaccggccctaaccttatttacgttggacgccgacgacagtcgaaaccttccgctactaacgttcggacgggggacccaagggggccc

SEQ ID NO: 366378 - DNA, 555 bp, Homo sapiens
  misc_feature: GZ8MTXP02JQIRM.10.38.D05.1.454.CMB.2.raw
  modified_base (226)..(226): a, c, t, g, unknown or other
  modified_base (320)..(320): a, c, t, g, unknown or other
  modified_base (364)..(364): a, c, t, g, unknown or other
  modified_base (395)..(395): a, c, t, g, unknown or other
  modified_base (449)..(449): a, c, t, g, unknown or other
  modified_base (533)..(533): a, c, t, g, unknown or other
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgttgcttataactatgtctcctggtaccagcaccaccaggcaaacgccccaaactccttgttttgaggtcagtaagcgccctnaggagtccctgatccggttctctcgcctccaagtctggacaacncggccctcctgaccgtctcgtcgggctccgngctgaggatgagctgtattactactcgcagcgctatacttcgacgccccaaagngggttcgttgggcggcgggtacgtaacggtcgtaaccggtccgttcgggccacggacccgaacggcctccgccccgtcggtccnctcttccgtccccaccttcccc

SEQ ID NO: 366379 - DNA, 573 bp, Homo sapiens
  misc_feature: GZ8MTXP02HMQ8W.10.38.D05.1.454.CMB.2.raw
  modified_base (340)..(340): a, c, t, g, unknown or other
  modified_base (353)..(353): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggccccgccaggcctccgaggggaaggggctggagtggggtctnagttatagaaacngatggcactacatattattctgactccgtgaacggggtccgtcaccctctccagagaccacttcccaaaacactatctttagtacttcttacactatcgacctacaaagttctaggagtacgtacgaacgaccgaccggcctaacctttattacgttcgtcgccggtacactatccgactaacgctaacttacgtcggaccggggaccgaggggtacccg

SEQ ID NO: 366380 - DNA, 639 bp, Homo sapiens
  misc_feature: GZ8MTXP02HZHF7.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactgggaggaggctggatccagccgtggggggtccctgagactctcctgtgcagcctctgggttcagcatcagtaacgactacatcgaccgtgggccccgccagggcctccgaaggggaacggggctgggagtggggtctcgtagttatagaaacagactggcactacatattattctgtacctccgtgaacggggtccggttaccaccccgtctcccaggacacctacttacccaaaacacctattccttagtaacttccttacactaacttcgacaacctaaattcccaaggaagacgttccggaaaccgaccaacccgggaccctaacctttaatttacgtttggaacgccggtaccgtaaacctagtacggaacctaaccggtcttaacccgtaaaaggtttcccgacggggggcctaacgggggaaccccg

SEQ ID NO: 366381 - DNA, 639 bp, Homo sapiens
  misc_feature: GZ8MTXP02F5JNI.10.38.D05.1.454.CMB.2.raw
  modified_base (228)..(228): a, c, t, g, unknown or other
  modified_base (244)..(244): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgtacttttgtnacttaataactatgtctctgtacagcaccaccagacaaacgcccctaaatctttgtttgagtcagtacgcgtcctgaggactcctagtactcggttctctcgccctacagtctagaccaacgccggccctcccgtgtacccgtctcgtcgggcctccgaggtcgtaggagatggagtctagtaacttactacgcgacacggctacctaagttacttaccggaaccggtaccccgtaaaggtggggtttcggttacggggaccggggacggttaaaacgttaacgggtccggtaaccggttccggttacgggaccgacggacccgtaacggcccgttacccggccccccgttggtaccctccgttccgtcccggtttccccccgtaccctttcccg

SEQ ID NO: 366382 - DNA, 526 bp, Homo sapiens
  misc_feature: GZ8MTXP02HB7V2.10.38.D05.1.454.CMB.2.raw
  modified_base (349)..(349): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtggggtctcagttatgaaacngatggcactacatattatctgactccgtgaacgggccgttcaccctctccagacgacaccttccaaacacattccttgtactcttacactatcgacacaattcagagacgtcgacgacacggccacttatacttgcgcgcgacatcgactaacgctacattcgcggggccaggggcc

SEQ ID NO: 366383 - DNA, 553 bp, Homo sapiens
  misc_feature: GZ8MTXP02IBX3F.10.38.D05.1.454.CMB.2.raw
  modified_base (504)..(504): a, c, t, g, unknown or other
  modified_base (509)..(509): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctcgggccccgccaggctccgaggggaaggggctgggagtggggtctcgagttatagaaacagatggacactacattattattctgtactccgtagaacggggtcccggttcacccctctccagacgacctaaccttccaaacaacctattcctagttactcttacactatgaccactaatcgtgaagacgtcgacgacaccggccacttaatnttgcncgcgacatgactaacgctacacttcgcggggaccaggggacccg

SEQ ID NO: 366384 - DNA, 565 bp, Homo sapiens
  misc_feature: GZ8MTXP02HI0D6.10.38.D05.1.454.CMB.2.raw
  modified_base (291)..(291): a, c, t, g, unknown or other
  modified_base (343)..(343): a, c, t, g, unknown or other
  modified_base (346)..(346): a, c, t, g, unknown or other
  modified_base (351)..(351): a, c, t, g, unknown or other
  modified_base (454)..(454): a, c, t, g, unknown or other
  modified_base (484)..(484): a, c, t, g, unknown or other
  modified_base (523)..(523): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaagggctggagtgggtctcagttatgaaacagatggcactacatattatctgactcgtgaacgggccgttcaccctctccagagacacttccaacacatcttntatcttcacatgcactaatctgagagtcgacgacacggccaccctattatgngcncgacntgactcgctcaattcgcggggccagggacgcccgaggtccacccgtcctccccagcccctaccgaccgaacgggccccacgttccgggtcccctttcccccgnggcccgccccgtcgccctaccggacggccnccgacccgtaccggacgacgccacggcggccggtcccgnggggcctcggccgtgtacgacgtacctactcccacttactcg

SEQ ID NO: 366385 - DNA, 543 bp, Homo sapiens
  misc_feature: GZ8MTXP02GOWZ5.10.38.D05.1.454.CMB.2.raw
  modified_base (301)..(301): a, c, t, g, unknown or other
  modified_base (488)..(488): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccncaggctccgaggggaagggctggagtgggtctcgagttatgaaacagatggcactacatattattctgactcgtagaacgggtccgttcaccctctccagacgacacttacccaaacactatcttgtactcttacacatcgacacaaatcagagacgtcgaacacgaacgcccaacttattattcgncggcaactatcgaactaacgtctactaaacttcgacggggacccagggggaaccg

SEQ ID NO: 366386 - DNA, 625 bp, Homo sapiens
  misc_feature: GZ8MTXP02GXE2B.10.38.D05.1.454.CMB.2.raw
  modified_base (442)..(442): a, c, t, g, unknown or other
  modified_base (479)..(479): a, c, t, g, unknown or other
  modified_base (486)..(486): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagctctctgtgcacgcctcgtggtcagcactcgaacgtaacgactacagtcgaccgtcgggcccgccgacggtcctaccggaaggggaacggggtcgtaggggtaggtcgggtcctagtagttagttaagaaaccgagtagtcggactactactattattactctcgtaccgtcggtaacggtacggggtcccgttaccncccgtcctaccgaggacacctactacccaaactactnttcgttntacttctacactatacacaactacgttcgaggaagtacgtaccggaacgaccgaccggtacctacttaaagtttcgttcggcgaccgactactagtaacaccgtacgtccttaagtaacgtttcggggacgggaaccgg

SEQ ID NO: 366387 - DNA, 548 bp, Homo sapiens
  misc_feature: GZ8MTXP02F78WZ.10.38.D05.1.454.CMB.2.raw
  modified_base (351)..(351): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgcaggctccgaggggaaggggctgggagtggggtctcgtagttatagaaacngatggcactacatattattctgactccgtgaacgggtccgttcaccctctaccagacgacacttaccaaacaactatcttagtatcttacacatgcacaatctagagacgtcgacgaccacggcccaacttattattgtacgcgtacgactatcgaacctaacgctacaacgttcgtacggggacccaggggacccg

SEQ ID NO: 366388 - DNA, 579 bp, Homo sapiens
  misc_feature: GZ8MTXP02HPJMK.10.38.D05.1.454.CMB.2.raw
  modified_base (403)..(403): a, c, t, g, unknown or other
  modified_base (411)..(411): a, c, t, g, unknown or other
  modified_base (426)..(426): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggtcagcatcagtaacgactacatcgacctcgggccccgccaggctccgaggggaaggggctgggagtgggtctcgagttatagaaacagactggcacgtacattattattctgactccgtgaacgggccgttcaccctntccagtanactacttacccaaanactattctagtactcttacacattgacactaatccgtagacgagtcgaacgactaccggacctaaccttattactttggcacccggtaacactacgtacgtaaccgtaacgtcttaacgtacgttccggaccggggaccgtaacggggacccg

SEQ ID NO: 366389 - DNA, 567 bp, Homo sapiens
  misc_feature: GZ8MTXP02IHRXB.10.38.D05.1.454.CMB.2.raw
  modified_base (350)..(350): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcatcagtaacgactacatgacctgggccccgcaggctccgaggggaaggggctggagtgggtctcgagttatgaaacngactgcactacattattatctgactccggtagaacggggtccgttcaccctctccagacgacctactacccaaacaacattcttgtactcttacactatcgacaacatcgtagaagacggtccgaacgaccaccggtcccaaactttattagttgacggacgaccgacacttgaacctcgacttacaacgtttcgcgggggacccaagggggtaccc

SEQ ID NO: 366390 - DNA, 634 bp, Homo sapiens
  misc_feature: GZ8MTXP02GIRQ3.10.38.D05.1.454.CMB.2.raw
  modified_base (361)..(361): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtgggggtccctgagactctcctgtgcagcctcgtgggtcagcatcagtaacgactacatcgacctcgggccccgcaggcctaccggaggggaaggggcgtgggaggtgggtctcgtagttaatagaaaacngagtggacactacattattattctgacctccggtaggaacggggtcccgttaccaccctctacccaagtacgaacctaccttacccaaaacaactacttctttagaacttcttacaactatacgactaaacctaaattcgtaagaagacggtaccgaaaccgaccgaaccggtcccctaaaaccttaagtttacgttacggtcgaccgacgtaactaagttcgaaacctaacgcttaaccgtaagttccggacgggggacccagggggaaccc

SEQ ID NO: 366391 - DNA, 671 bp, Homo sapiens
  misc_feature: GZ8MTXP02IB5IZ.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggcccgccgacggcgtccgaggggaacgggggcggtgggaggtaggggtcgtcgtacgttagttagaaacgagatgggactactaacataattattctgtacgtccgtagacggggtccggttcgaccctacctcgacgagaactacctaccaaacaactacttcttacgttacttcttaccactaaacgtcgtaccacaaactcctaggaacgtacgtaccggaaaccgacgaacccggacctaaacccttaactttaagtttcggttacgaccggtccggaaacctaacggttacggtaaaccctaaaccggttcctaacccgttaaacgttaaccggtttcggggggaccccgtaaaacgggggtaccccgggg

SEQ ID NO: 366392 - DNA, 550 bp, Homo sapiens
  misc_feature: GZ8MTXP02G3IZT.10.38.D05.1.454.CMB.2.raw
  modified_base (349)..(349): a, c, t, g, unknown or other
  modified_base (430)..(430): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggcctccgaggggaaggggctggagtgggtctcagttatgaaacngatggcactacatattatctgactcgtgaacgggccggtcaccctctccagacgactacttacccaaacaactattcgttntacttccttacaactatgacaccaaatctagagacgtcgacgacgacgacccaacttacgttattggtacgcgacgactagtcgaactcgactactacttcgacggggcccagggacccg

SEQ ID NO: 366393 - DNA, 554 bp, Homo sapiens
  misc_feature: GZ8MTXP02HMZZN.10.38.D05.1.454.CMB.2.raw
  modified_base (219)..(219): a, c, t, g, unknown or other
  modified_base (355)..(355): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacngatggcactacatattattctgactccgtgaagggccggttcaccctctccagagacacttccaacaacatcttgtatcttcacatgcacaatctgagagtcgacgacacggccacccctattattgtgcgcgacntgactacgctacaattcgtggggccagggagcccaggtccaccgtctccccagccctccaccaacgggcccacgtccggtccctttcccccgcgggtcccgcccctcgcctcccgacggacgccacctccgaacgacggccacgacgccggccctcggggctcgccgtggtcaacggacctaccttcccacttactacg

SEQ ID NO: 366394 - DNA, 609 bp, Homo sapiens
  misc_feature: GZ8MTXP02GW4U5.10.38.D05.1.454.CMB.2.raw
  modified_base (409)..(409): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacatgacctcgggccccgccaggcctccgaggggaaggggctgggaggtgggtctcgagttatagaaacagatggacactacattattatctgactccggtagaacggggtccgttacacccctntccgagacgacctaccttacccaaacaactattcttgtactcttacacatcgaccaactaagtctaggagacgtaccgaacgaccgaccggccctaaaccttatttacgttcggtcggaccgacgtaactacgtacgttaacccgaacgtcccttaaacgttaacgttccgggtacgggggacccgaacgggggaccccg

SEQ ID NO: 366395 - DNA, 584 bp, Homo sapiens
  misc_feature: GZ8MTXP02JOOWM.10.38.D05.1.454.CMB.2.raw
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccgagggcctccgaggggaacggggcgtgggaggtggggtctcgagttatagaaacagatggacactacatattattctgactccggtagaacgggtcccggttccaccctctaccagacgaccaccttacccaaacactattcttagtacttccttacactatcgacaactaatctagagacgtcgacgacgacggccctaacgttattactggtacgcgacgactactcgaacctaacggcttacgtaactttccggacgggggacccagggggacccg

SEQ ID NO: 366396 - DNA, 609 bp, Homo sapiens
  misc_feature: GZ8MTXP02HPTOZ.10.38.D05.1.454.CMB.2.raw
  modified_base (301)..(301): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttccttgttgctattcaaaggtgtccactgtgaggttcaactggtggagacgtggaggaggctggatccagccgtgggggtccctgagactctcctgtgcagcctcgtggtcagcatcaagtaacgactacatcgacctgggccccnccagggcctccgaaggggaacggggcgtgggagtgggtctcagttatagaaacagatggacactacattattattctgactccgtagaacggtccgttcaccctctccagacgactaccttacccaaacaactacttcttagtacttccttacacctattcgactaactaatcagaacgacgtaccgaccgaccgaccggaccctaacctttaatttagtttggcgtaccggacgaacgtacttacgaaccttaaccggcccttaacgttaaacgttcggtaccggggggcccttaagggggaccccg

SEQ ID NO: 366397 - DNA, 617 bp, Homo sapiens
  misc_feature: GZ8MTXP02HO77S.10.38.D05.1.454.CMB.2.raw
  modified_base (356)..(356): a, c, t, g, unknown or other
  modified_base (404)..(404): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctgtgggtcagcatcagtaacgactacatcgacctcggggccccgccaggcctccgaggggaaggggctgggagtggggtctcgtagttattgaaacngactggacactactatattatctgactcgtgaacgggccgtcaccctnccgagacacacttaccaaacactattcttagtactcttacaactatcgtacaactaatcctaggaacgacggtaccgaacggaaccaaccgggtccctaaaccgtttaatttaccgtttagtcggaccggtaccgaacctgttaacggaccttaaccggacttaacccgtaaaatttcccggggacgggggtaccctaacgggggaacccccg

SEQ ID NO: 366398 - DNA, 535 bp, Homo sapiens
  misc_feature: GZ8MTXP02JBDWU.10.38.D05.1.454.CMB.2.raw
  modified_base (302)..(302): a, c, t, g, unknown or other
  modified_base (348)..(348): a, c, t, g, unknown or other
  modified_base (396)..(396): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattttcaaaaggtgtccactgtgaggttcaactggtggagactggaggaggctggatccagccgtggggggtccctgagactctcctgtgcagcctctgggtcagcatcagtaacgactacatcgacctgggccccncaggctccgaggggaaggggctggagtgggtctcagttatgaaacngactggacactacatattatctgactcgtgaacgggtccgtcaccctnccagacgacacttaccaaacacatcttgactcttacactatcgacacaatctagagagtccgaacgaccgacggcctaacctattactgtacgcgacgacatcgaactaacgctacagttcgcggggaccagggacccg

SEQ ID NO: 366399 - DNA, 524 bp, Homo sapiens
  misc_feature: GZ8MTXP02JTSUI.10.38.D05.1.454.CMB.2.raw
  modified_base (437)..(437): a, c, t, g, unknown or other
  modified_base (444)..(444): a, c, t, g, unknown or other
  modified_base (486)..(486): a, c, t, g, unknown or other
  modified_base (494)..(494): a, c, t, g, unknown or other
  modified_base (503)..(503): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttagctatttcaaaaggtgtccactgtgaggttcaactggtggagactggaggaggctggatccagcctggggggtccctgagactctcctgtgcagcctcgtgggttcagcatcagtaacgactacatgacctgggccccgccaggctccgaggggaaggggctgggagtggggtctcgtagttattagaaacagatggacactacattattattctagactccgtgaacgggccggttacacccgtctccagacgacacttccaacacagtctntatcttnacatgacacatctgacgagtcgacgacacgccactactatgngcgcgacntcgactcgntacattcgacggccagggacc

SEQ ID NO: 366400 - DNA, 580 bp, Homo sapiens
  misc_feature: GZ8MTXP02IZPLO.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatgacctcgggccccgccaggcctccgaaggggaaggggctgggagtgggtctcagttatagaaaacagatggacactacataatttattctgaacttcccgtagaaacggggtcccgtttaccaccccttctacccgaagaacgaacctaacctttacccaaaaacaacctaagttcttagtactcctttacaaactagtcacaactaatcagagagtcgaacgactacgcccaacttattagtgcgcacgacatcgaactaacgctacaattcgacggggaccaggggaccg

SEQ ID NO: 366401 - DNA, 553 bp, Homo sapiens
  misc_feature: GZ8MTXP02HBMN1.10.38.D05.1.454.CMB.2.raw
  modified_base (220)..(220): a, c, t, g, unknown or other
  modified_base (357)..(357): a, c, t, g, unknown or other
  modified_base (376)..(376): a, c, t, g, unknown or other
tcagcatagtagtgcacgaccggtgctcgatttagtatctgatagttgggtttgggctgtgaggttcaactgttggagactggaggaggctggatccagcctggggggtccctgagactctcctgtgcagcctctgggttcagcatcagtaacgactacatgacctgggcccgccaggctccaggggaaggggctggagtgggtctcagttattgaaacngatggcactacatattattctgactccgtgaagggccggttcaccctctccagagacacttccaacaacatcttgtatcttcacatgcacaatctgagagtcgaacgacacggccacccctattactgtgcgcgacntgactacgctacaattcgnggggccaggggacgcccgacggtcacccgtcctccccacgccctcccaccgaacgggcccagtccggtccttccccctggccgccctcgcctccgaggacgccaccgtccgacgacgccacgacgccggccctcggggcctcgccgtggtcaacggacctaccttcccactactacg

SEQ ID NO: 366402 - DNA, 530 bp, Homo sapiens
  misc_feature: GZ8MTXP02JDMZ7.10.38.D05.1.454.CMB.2.raw
  modified_base (349)..(349): a, c, t, g, unknown or other
  modified_base (445)..(445): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggtttttccttgttgctattttcaaaaggtgtccactgtgaggtttcaactggtggagactggaggaggctggatccagcctggggggtccctgagactctcctgtgcagcctctgggttcagcatcagtaacgactacatgacctgggcccgccaggctccgaggggaggggctgggagtgggtctcagttatgaaacngatggcactacatattatctgactccgtgaacgggtccgttcaccctctccagagacacttcccaaacacattctgtatcttcacatgcacaatcngagagtcgacacacgccactattattgcgcgcgacagtgaaccttaacgcctactaacgttcgtacgggggacccagggggaccg

SEQ ID NO: 366403 - DNA, 570 bp, Homo sapiens
  misc_feature: GZ8MTXP02GPRCQ.10.38.D05.1.454.CMB.2.raw
  modified_base (300)..(300): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccnccaggcctccgaggggaaggggctgggagtgggtctcgagttatagaaacagatggcactacatattatctgactccgtgaacggtccggttcaccctctcccaagacgaccacttacccaaacaacagttccttgtaatccttacacatgcaactaatcagagactcgaaccgacaccggaccaacctttacttatttcgggcgaccgacgtacacgtacgaccgtaaccgtactacgtacgttcggtacgggggaccgacggggaccg

SEQ ID NO: 366404 - DNA, 542 bp, Homo sapiens
  misc_feature: GZ8MTXP02JKZY0.10.38.D05.1.454.CMB.2.raw
  modified_base (301)..(301): a, c, t, g, unknown or other
  modified_base (350)..(350): a, c, t, g, unknown or other
  modified_base (370)..(370): a, c, t, g, unknown or other
  modified_base (428)..(428): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtccctgagactctcctgtgcagcctctgggttcagcatcagtaacgactacatgacctgggcccnccaggctccgaggggaaggggctgggaggtgggtctcagttatgaaacngatggcactacatattatcngactcgtagaacgggtccgttcaccctctccagacgacacttaccaaacacattcttnatcttcacatcgacaacaatctgagtagtccgaacgaccgacggccctaaccttatttacgttgcgcgacacatgaacctaacgctactaacttcggacgggaccagggacccg

SEQ ID NO: 366405 - DNA, 686 bp, Homo sapiens
  misc_feature: GZ8MTXP02FVYXW.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcacgcctcgtgggttcagcatcagtaacgactacatcgaccgtcgggccccgccgaggcctaccggaggggaaggggcgtgggaggtggggtctacgtaggtttaactagaaaacagagtggactaactactaattatttactttccgtaggtacccgttaccgggtacgggaaaccgggggtccccggtttaccacccccttaccgtacccgaacggtaaccgaaacccttaaccctttaacccaaaaactaaacctaactttccgtttacgttacttcctttaccaactaagttcgacctaacctaaatctagaacgacgtaccgaacgaccgaccggacctaaccgttattagttacgtcgacgaccgactactcgaacctaacggcttaacgtaacgttcggtaccgggggaccaacggggaccccg

SEQ ID NO: 366406 - DNA, 618 bp, Homo sapiens
  misc_feature: GZ8MTXP02JM6LG.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcgaagtaacgactaacatcgaccgtcgggccccgccgacggcctaccggaaggggaaggggcgtgggaggtgggtctacgtagttagtagaaacgtagacgtggaccactaacgtattaattacttcgtacgtaccttccggtagggaaccgggggtcccgttacccacccttccgtaccaacggactactaacccttacccaaaactaaccattaccgtttatacttcttacactatcgacactatctagagacgtacgcgaaccgcgtaccacttattagttgacgcgacgactactacgaacgtcgctactaacgttccggtacggggacctacggggaccc

SEQ ID NO: 366407 - DNA, 669 bp, Homo sapiens
  misc_feature: GZ8MTXP02HRW8V.10.38.D05.1.454.CMB.2.raw
  modified_base (297)..(297): a, c, t, g, unknown or other
  modified_base (303)..(303): a, c, t, g, unknown or other
  modified_base (414)..(414): a, c, t, g, unknown or other
  modified_base (423)..(423): a, c, t, g, unknown or other
  modified_base (459)..(459): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggtttcgtgttagctattcaaaaggtgtccactgtgaggttcaactggtggagactggaggaggctggatccagccgtggggggtccctgagactctcctgtgcagcctgtggtcagcatcagtaacactacatcgacctgggcccncaggcnccgaggggaagggctgggagtgggtctcgagttatagaaacagtaagtggacctactaacattattagtctagtactccggttaggaacggggtcccgtttacaccccctnacccgaganaacctaccttacccaaaactactacggtttaccttntaactctttaacaccggtaaattcggacaacctaactacttagtaacggtacggtaaccggaaccggaaccgtaaccgggacccgtaaccccgttaaactttaaacgtttacggttaggtccgggtaccgtaaccgaacgttacgaaccgttaaccgaccgtaacctaacgttaacggttcggggtaccggtaacgggtaaaccccgggg

SEQ ID NO: 366408 - DNA, 559 bp, Homo sapiens
  misc_feature: GZ8MTXP02GIXJN.10.38.D05.1.454.CMB.2.raw
  modified_base (357)..(357): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctctgtaccagcaccacccaggcaaacgcccccaaatcctttgttttgagtcagtaagcggcctcaggactccctgatcggtctctcgcctcagtctgcacncgcctcctgaccgtctcgtcgggcctcgaggctgacggatgagctgtattactactgcagcgctatacttcgacgacccccaagtagggttgtttcgggcggtacgggtaacgtaaggtcgaccggtcgtcgggtacacgcccgtaacggccgtaccgcccccgtcggtctaccgtccgtccgttcccccgccctttccccg

SEQ ID NO: 366409 - DNA, 542 bp, Homo sapiens
  misc_feature: GZ8MTXP02GEEXR.10.38.D05.1.454.CMB.2.raw
  modified_base (239)..(239): a, c, t, g, unknown or other
  modified_base (318)..(318): a, c, t, g, unknown or other
  modified_base (357)..(357): a, c, t, g, unknown or other
  modified_base (434)..(434): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttataactatgtctctggtaccagcaccacccaggcaaacgccccaaactcctttgttttgagtcagtaagcggcctnaggactccctgatcggtctctcgcctcagtctgacaacncgcctcctgaccgtctcgtgggcctccgagctgagatgagctagattacactgcagcgcatatcgacgaccccaagngggttgttgggcggtcgggacgttaaggtcgtacccgtcgtcggggtcacggacccgaacggcctccgcccccgtggtcctacgtccgtccgttccccaccctttccc

SEQ ID NO: 366410 - DNA, 540 bp, Homo sapiens
  misc_feature: GZ8MTXP02GD008.10.38.D05.1.454.CMB.2.raw
  modified_base (336)..(336): a, c, t, g, unknown or other
  modified_base (487)..(487): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtggggtcnctagttattgaaaactgatggcactacattattattctgactccgtagaacggggccgttcaccctctcccagagacacttccaaacaacatcttgtatcttacacatgcaacaatctagagagtcgacgacacggcctaccatttttacngttgcgcgtacatcgactaacgctacaaacttcgtacggggcccaggggaccg

SEQ ID NO: 366411 - DNA, 544 bp, Homo sapiens
  misc_feature: GZ8MTXP02F0G08.10.38.D05.1.454.CMB.2.raw
  modified_base (221)..(221): a, c, t, g, unknown or other
  modified_base (264)..(264): a, c, t, g, unknown or other
  modified_base (270)..(270): a, c, t, g, unknown or other
  modified_base (303)..(303): a, c, t, g, unknown or other
  modified_base (337)..(337): a, c, t, g, unknown or other
  modified_base (344)..(344): a, c, t, g, unknown or other
  modified_base (363)..(363): a, c, t, g, unknown or other
  modified_base (441)..(441): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctggagtgggtctcagttattgaaacngatggcactacatattatctgactcgtgaggccgttcacctcnccaganacactccaacaacatcttgtatctcacatgcanaatctgagagtcgacgacacgccacctattatgncgcgacntgactacgctacaattcgnggggccagggacgcccgaggtccacccgtcctccccagccctccaccgaacgggcccctagtccggtcccttccccgnggcccgccctcgcctccgaggacgcaccgtcgagacgcacgacgccggcccgtgggctcggccgtggtaccaaacggtacctaccgttacccaacttactacg

SEQ ID NO: 366412 - DNA, 526 bp, Homo sapiens
  misc_feature: GZ8MTXP02JXX9N.10.38.D05.1.454.CMB.2.raw
  modified_base (351)..(351): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggcccgccaggctccgaggggaaggggctgggagtgggtctcagttatgaaaccngatggcactacatattattctgactccgtgaacgggtcccgttcaccccgtctcccagacgaccacttccaaacaacatcttgtacttcttcacatcacacaatctagagagtcgacgacacgccactatacttgcgcgcgacatcgactacgctactacgttcgtagggacccg

SEQ ID NO: 366413 - DNA, 468 bp, Homo sapiens
  misc_feature: GZ8MTXP02H083K.10.38.D05.1.454.CMB.2.raw
  modified_base (238)..(238): a, c, t, g, unknown or other
  modified_base (458)..(468): a, c, t, g, unknown or other
tcagcatagtagtgcacgaccggtgctcgatttagtatctgatagttgttggaagtgtctctggagtgggtctcagttattgaaacagatggcactacatattattctgactccgtgaagggcggttcaccctctccagagacacttccaacaacatcttgtatcttcacatgcacaatctgagagtcgacgacacggccacctattattgtgcgcgacatgactacgctcaattcgnggggccagggacgcccaggtcaccgtctccccagccctccaccacgggcccatccggtccttccccctggcccgcccctgcctccagggacgccaccctccgagacgcaccgacggcccgcccgtggggctcggcccctggggtaccgaaacggtacccttaccttacccccacttactactcgacctggacggcggggctgggacaacgggcgcatagnnnnnnnnnnn

SEQ ID NO: 366414 - DNA, 584 bp, Homo sapiens
  misc_feature: GZ8MTXP02GP9T2.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctcgggccccgccgagggcctccggaggggaaggggcgtgggaggtggggtctcgtagttatagaaacagagtggcactacatattatctgactcggtagaacgggtccgttacaccctctcagacaccacttaccaaacaacacttcttagtacttcttacacagtcacaactaactcgtagacgacgtacgaacgaccgacggaccctacgttatttacgttgtcgaccgacgaacctatcgtaacctaaccgtctactacgttccggcggggacccgaaggggtcccg

SEQ ID NO: 366415 - DNA, 538 bp, Homo sapiens
  misc_feature: GZ8MTXP02IPG42.10.38.D05.1.454.CMB.2.raw
  modified_base (412)..(412): a, c, t, g, unknown or other
  modified_base (456)..(456): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagccctcgtgggttcagcatcaagtaacgactacatgacctcgggccccgcaggctccgaggggaagggctggagtgggtctcagttatgaaaacagatggacactacattaattattctgactccgtgaacggggtccgttcaccctctcaganacacttccaaacaacatcttatactcttacacatgacacaatcngagatcgaacgcaacggccacttaattattgtgcgacgaacactgactaacgctacgtaacttcgtacgggacgagggaccg

SEQ ID NO: 366416 - DNA, 548 bp, Homo sapiens
  misc_feature: GZ8MTXP02JLR2M.10.38.D05.1.454.CMB.2.raw
  modified_base (301)..(301): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggcccncaggctccgaggggaggggctgggagtgggtctcgagttatgaaacagatggcactacatattatctgactccgtagaagggtccgttcaccctctcccagacgacaccttaccaaacaaccattccttagtactcttacactatcgacacaatctgagacgtcgacgacgaccggccaaccgttattacttgtcgccgactacatcgactaaccgctacaacgttcgacggggacccaggggaccg

SEQ ID NO: 366417 - DNA, 598 bp, Homo sapiens
  misc_feature: GZ8MTXP02HEEF8.10.38.D05.1.454.CMB.2.raw
  modified_base (250)..(250): a, c, t, g, unknown or other
  modified_base (259)..(261): a, c, t, g, unknown or other
  modified_base (263)..(263): a, c, t, g, unknown or other
  modified_base (272)..(272): a, c, t, g, unknown or other
  modified_base (300)..(300): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcgtggtttcgtgtaggctattacaaaggtgtccatgtgaggttcaatggtggagatggaggagctggatccagccgtgggggtccctgagactctcctgtgcngctgtggtnnnancagacacanatcgacgcggccgcgcgcgcgaggaggngtggtaggtggtcgtcgtagtagtagtaacgagacgtcgtactactactattattacttcgtacgtacgtaccggtacggtacgggtaccggtaccgtacccgtacctacgtacgtacgacctacctaaccctaactaactacttacttacttacttactactactactacgtactaactactacgtacgacgtacgtacgacgaccgaccgaccgtacttacgttagttacgtacgtacgacgtacgtactacgtacgtaacgtacgtactacgtacggtacggtacggacggacgg

SEQ ID NO: 366418 - DNA, 580 bp, Homo sapiens
  misc_feature: GZ8MTXP02FPQAA.10.38.D05.1.454.CMB.2.raw
  modified_base (358)..(358): a, c, t, g, unknown or other
  modified_base (420)..(420): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtgggccccgccaggcctccgaggggaagggcgtgggagtggggtctcgtagttatagaaaacngactggacactacattattattctgactccggtagaacgggtccgtacaccctctccagganacaccttccaaacgactattcttgtactcttacacatacacaactaatcctagaagacgtacgaaccgacgaccggacctaacctaatttacgtgtacgccggacacctatcgaactaaccgtctacgtaacgttccggacgggacccgagggaaccccg

SEQ ID NO: 366419 - DNA, 532 bp, Homo sapiens
  misc_feature: GZ8MTXP02JA8EB.10.38.D05.1.454.CMB.2.raw
  modified_base (350)..(350): a, c, t, g, unknown or other
  modified_base (485)..(485): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatgacctgggccccgccaggctccgaggggaaggggctgggagtggggtctcagttatgaaacngatggcactacatattattctgactccgtgaacggggccgttcaccctctccagacgacacttaccaacacatctgtatcttcacatcgcaacaatctagagacgtcgaacgacaccggccaaccttattattgngcgacgacatcgactaacgctacgattcgcgggggaccaggggaccg

SEQ ID NO: 366420 - DNA, 622 bp, Homo sapiens
  misc_feature: GZ8MTXP02G4AXK.10.38.D05.1.454.CMB.2.raw
  modified_base (387)..(387): a, c, t, g, unknown or other
  modified_base (461)..(461): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcagtaacgactacatcgacctgggccccgccagggctccgaggggaaggggctgggagtggggtctcgtagttaattagaaactagactggactactaactattattatttcgngtacctccggtaggaacggggtcccgtttccaaccccttcacccgaagacgacctacccttaaccaaacaactnttcttataactcttacactatcgactaaccaagttccgtagaacgtacggtacgaaccgacgaacccggtacctaacccttattacgttgccgacgaccgactagtccgtactaaccgcctacgtaaacgtttccggacggggaccccgaggggaaccccg

SEQ ID NO: 366421 - DNA, 613 bp, Homo sapiens
  misc_feature: GZ8MTXP02H6BPV.10.38.D05.1.454.CMB.2.raw
  modified_base (308)..(308): a, c, t, g, unknown or other
  modified_base (434)..(434): a, c, t, g, unknown or other
  modified_base (445)..(445): a, c, t, g, unknown or other
  modified_base (449)..(449): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactgggaggaggctggatccgagccgtgggggtccctgagactctcctgtgcagcctcgtgggttcagcatcaagtaacgactacatcgaccgtcgggcccnccgaggctccgaggggagggctggagtgggtctcagttaatagaaacagagtggactactacattattattcagtactccgtagaacgggtcccgtcaccctcctcagacactactaccaaacacnttctgtatctnaacntcgacaactatcgtagaacgtacgtccggaacaccgacggacccctaaacctttaatttaaccgtttggacgaccggaccgtaactaacgttacggaacccttaaccggacttaaccgtaaacggtttccgggaccgggggtaaccccgaagggggaacccccg

SEQ ID NO: 366422 - DNA, 600 bp, Homo sapiens
  misc_feature: GZ8MTXP02JXTCC.10.38.D05.1.454.CMB.2.raw
  modified_base (443)..(443): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccgagccgtgggggtccctgagactctcctgtgcagcctcgtgggttcagcatcagtaacgactacatcgaccgtcgggccccgccaggcctccgaggggaaggggctgggaggtgggtctcgtagttatagaaacagactggacactacattattacttcagactcgtgaacgggtccgttcacccttctaccaagacgactacttacccaaacaactnttcttagtacttcttacactagtcacaacacttgaggagtacggtacccgaacgtaccgaccggtacctaaccgtttaattagttcgcgacgtccgaaatctacggtaacctaacgtctaaccgtacgttccggacgggggacccgaagggaccccg

SEQ ID NO: 366423 - DNA, 518 bp, Homo sapiens
  misc_feature: GZ8MTXP02HVM6I.10.38.D05.1.454.CMB.2.raw
tcagcatagtagtgcacgaccggtgctcgatttagtatctgatagttgggtttgggggagaggagcccagcactgggattcctaggtgtttccattcggtgatcagcactgaacacagaggactcaccatggagttttggctgagctgggttttcctcgttgctcttttaagagatgtccagtgtcagatgcagatggtggagtcgtgggggagcgtggtccggcctggggggtccctgagactctcctgttctgcgtctggattcatctttagtaaatctggcatgtcctgggtccgccaggttccaggccacgggctggaatgggtggcagatatacaatatgatgacagtaaaatatactatgagactcttcaagggccgattcaccatctccagagacaattccaaagacatggtgtatcttgacaaatcgaccagcctgagagccggaggacgtacgggttgtttatacgtggtagggacgaaactcgagtggcactcactggtattgtacgg

SEQ ID NO: 366424 - DNA, 570 bp, Homo sapiens
  misc_feature: GZ8MTXP02JDMZO.10.38.D05.1.454.CMB.2.raw
  modified_base (352)..(352): a, c, t, g, unknown or other
  modified_base (523)..(523): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctattttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtggggtctcagttatgaaacngatggcactacatattattctgactccgtgaacgggtccgttcacccctctccgaagacgactaccttacccaaacaactattccttgtacttcttacacattcgaccaactaattccaggacgagtccgaacgacacccggaccctacttaattcgttgtcgcgaccganactcgaaactcgcctactatttccggcgggggacccaggggaacccg

SEQ ID NO: 366425 - DNA, 568 bp, Homo sapiens
  misc_feature: GZ8MTXP02HIF6V.10.38.D05.1.454.CMB.2.raw
  modified_base (302)..(302): a, c, t, g, unknown or other
  modified_base (415)..(415): a, c, t, g, unknown or other
  modified_base (427)..(427): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgacctcgggccccnccagggcctccgaggggaaggggctgggaggtggggtctcgtagttatagaaacagatggacactacataattatctagactccgtagaacggggtccgtcaccctctcaganacacttccaaanacatcttagtatcttcactatcgacacaagtcagacgagtccgaacacgaccggccaacccgttatttacgttcgtcgaccgacgtaccatacggactaaccgctactaaacgttcggtacggggaccggacgggacccgg

SEQ ID NO: 366426 - DNA, 563 bp, Homo sapiens
  misc_feature: GZ8MTXP02JG6W8.10.38.D05.1.454.CMB.2.raw
  modified_base (348)..(348): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggcccgccaggctccgaggggaggggctgggagtggggtctcagttatgaaacngactggcactacatattattctgactcggtgaacggggtcccgtcaccctctccagacgacacttacccaaacacacttcttagtacttccttacacatcgacaacaatcgtagagacgtcgacgacaccggaccaaccgttattagttgtacgcgaccgactatcgaaccttaacggctactaacgttccggtacggggacccgaagggacccg

SEQ ID NO: 366427 - DNA, 527 bp, Homo sapiens
  misc_feature: GZ8MTXP02HDKL5.10.38.D05.1.454.CMB.2.raw
  modified_base (482)..(482): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggcccgcagggcgtccggggaagggctggagtgggtctcgagttatgaaacagatggcactacatattatctgactcggtgacgggtcccgttcaccctctccagacgacactacaacacatcttgtatctcacatgcacatctgacgagtcgacgaccacggccaactattatcgtgacgtcgaaacngtacgacctacgctacaacgtttcgacggggcacggggcacccgg

SEQ ID NO: 366428 - DNA, 555 bp, Homo sapiens
  misc_feature: GZ8MTXP02ID39J.10.38.D05.1.454.CMB.2.raw
  modified_base (355)..(355): a, c, t, g, unknown or other
  modified_base (367)..(367): a, c, t, g, unknown or other
  modified_base (377)..(377): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggccccgccagggcctcccgaggggaaggggctgggagtgggtctcagttattgaaacngatggcactacnttaaaaattnttctgactccgtagaacgggtccgtcacccgtctccagacgacacttacccaacaaacatctgtactcttacaccatcgacacaatctagagagtcgacgaccacggccaacctattacttgtcgcgcgacactacgactaacgctactaacgttcgtcggggacctacggggacccg

SEQ ID NO: 366429 - DNA, 575 bp, Homo sapiens
  misc_feature: GZ8MTXP02IVIC3.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgaccgtcgggccccgccgacggctccgaggggaagggcgtggaggtgggtctcgagttatagaaacagatggacactacattattattctgactccggtagaacgggtccgttacaccctctccagacgaccacttacccaaacaactactcgttatactcttacactagtcacacaatctagagacgtcgaacgaccaccggacctaacgttattacgtggcgtcgacgactactcgaacttaaccgctaacgtacgttcggtcggggaccgtaacggggacccg

SEQ ID NO: 366430 - DNA, 573 bp, Homo sapiens
  misc_feature: GZ8MTXP02IREVY.10.38.D05.1.454.CMB.2.raw
  modified_base (350)..(350): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggccccgccaggctccgaggggaaggggctgggagtgggtctcgagttatgaaacngatggcactacatattatctgactccggtagaacggggccgttcaccctctcagagacacttaccaaacaacattcttagtactcctttacactatcgcaactaatcctgacgagtcgaaacgacaccggcctaaccgttattacgttggtcgaccgacgactacgtcggaaacctaacgactactaaacgttccggtacgggggaccctaacgggggacccg

SEQ ID NO: 366431 - DNA, 573 bp, Homo sapiens
  misc_feature: GZ8MTXP02J3LGV.10.38.D05.1.454.CMB.2.raw
  modified_base (382)..(382): a, c, t, g, unknown or other
  modified_base (389)..(389): a, c, t, g, unknown or other
  modified_base (402)..(402): a, c, t, g, unknown or other
  modified_base (407)..(407): a, c, t, g, unknown or other
  modified_base (516)..(516): a, c, t, g, unknown or other
tcagcatagtagtgcacgaccggtgctcgatttagtatctgatagttgggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccgagggcctccggaggggaaggggctgggagtgggtctcgagttatagaaacagactggacactacatattatcngactcgngacggccgttacnccctntcccagacgacctaccttaccaaacactagttcttagtactcttacgacagtcacactaattcagagtacgaccgaacgacaccgaccctaacttattacttgcgaccncgtacacgttcgaaccttcgcctactaacgtttcggacggggacccagggggacccg

SEQ ID NO: 366432 - DNA, 689 bp, Homo sapiens
  misc_feature: GZ8MTXP02J2DV0.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacccgtgggccccgccgacgggctccgaggggaaggggcgtgggaggtgggtctctagttattagaaacagacgtcggacaactactattaattattccgtagtaccgtccggtagaaccggggtcccggtttaccaccccgtctacccgagaacgtaacctaaccttacccaaactaacctattcctttagttaacttccttaccgaactactacgacctaaaccgtaaattccgtaggaacggttaacggtacccgaaccggaacccaacccggggtacccctaaacctttatttacgttcggaaccggccgaccggtaacagttaccggaacctaaccggtacctaccgttaacgtttccggggtcgggggaaccccggtaggggaacccccgg

SEQ ID NO: 366433 - DNA, 571 bp, Homo sapiens
  misc_feature: GZ8MTXP02G0NVC.10.38.D05.1.454.CMB.2.raw
  modified_base (358)..(358): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtgggccccgccaggcctccgaggggaaggggctgggaggtgggtctcgtagttatagaaacngatggcactactatattatctgacttccgtagaacggggtccggttaccacccctctccgaagacgaacccacttacccaaactaacctattctttagtacttccttaccaactatcgacacaacttcagagacgtacgacgacaccggccacttattacgttgcgtccgacgacatcgactaacgctactactcggacgggccaggggaccg

SEQ ID NO: 366434 - DNA, 537 bp, Homo sapiens
  misc_feature: GZ8MTXP02JQUH6.10.38.D05.1.454.CMB.2.raw
  modified_base (351)..(351): a, c, t, g, unknown or other
  modified_base (398)..(398): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctggagtggggtctcgagttatgaaacngatggcactacatattatctgactcgtgaacgggtccgttcaccctntcccagacgacctacttcccaaacacattccttagtatccttacactatcgaccaacaactctagagtacgtcgacgacacggccacttatatgcgcgcgacactcgactcgctactacttcgcggggaccagggaccg

SEQ ID NO: 366435 - DNA, 551 bp, Homo sapiens
  misc_feature: GZ8MTXP02HFNNY.10.38.D05.1.454.CMB.2.raw
  modified_base (300)..(300): a, c, t, g, unknown or other
  modified_base (349)..(349): a, c, t, g, unknown or other
  modified_base (470)..(470): a, c, t, g, unknown or other
  modified_base (503)..(503): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggtcagcatcagtacgactacatgacctgggccccnccaggctccgagggaaggggctggagtgggtctcgagttattagaaacngacgtggcactaacattattattctgaacttccggtgaacgggtccggtcacccgtctcccaggacgacctacttacccaaactacagttctttgtactcttacactatcgcaacattccngagagtccgacgacacggaccacttatatgtcncgacgacatcgactaacggctactacgtcgtcggggaccaggggtacc

SEQ ID NO: 366436 - DNA, 587 bp, Homo sapiens
  misc_feature: GZ8MTXP02HFW0X.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgacctcgggccccgccgaggcctccgaggggaaggggctgggaggtgggtctcagttatagaaacagatggcactactatattatctgactccgtgaacgggtccgtcactctctccagacgacctacttacccaaacaactacttctttagtaacttccttaccaactattcgacctaactaaatccgtagaacgtacgtacgaaccgaccacggaccctaaccgttattagttcgtcgcgacgacacgttacgaactacgacctactaaacgtccggtacggggacccgtacgggg

SEQ ID NO: 366437 - DNA, 608 bp, Homo sapiens
  misc_feature: GZ8MTXP02HLE64.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctcgggccccgccaggctccgaggggaaggggctgggagtgggtctcagttattagaaacagatggcactacatattatctgactccgtagaacgggtcgtccaccctctcagacgactacttacccaaacactacttcttgtacttcttacaaacctattcgaccaactaaatccgtagaagacggttaccgaaccgaacaacccgggccctaaaaccctttattacgttaggtcggacgacccggaatacgttcgaacccgttaacgccttacgtaaaacgtttccggacgggggaccctaagggggaccccgg

SEQ ID NO: 366438 - DNA, 572 bp, Homo sapiens
  misc_feature: GZ8MTXP02HQSEZ.10.38.D05.1.454.CMB.2.raw
  modified_base (251)..(251): a, c, t, g, unknown or other
  modified_base (264)..(264): a, c, t, g, unknown or other
  modified_base (269)..(269): a, c, t, g, unknown or other
  modified_base (280)..(280): a, c, t, g, unknown or other
  modified_base (305)..(305): a, c, t, g, unknown or other
  modified_base (307)..(307): a, c, t, g, unknown or other
  modified_base (310)..(310): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtggtttcgtgttaggctatttcaaaaggtgtccatgtgaggttcaatggtggagatggaggaggctggatccagcctggggggccctgagactctcctgtgcncgctcgtggtcgngcatnagacactacancgcgcggccgcgcgcgcgaggaggngnggnggtggtcgtgtagtagtagaagagagagacactactattattattctcgtacgtcgtacgtacgggtccgtacctaccctctacacgacgactacctaacctaactaactacttacttacttacttactactactactactactaactaactactagtagtacgtacgacgacgaccgacctaacttaacttacgttagtcgtacgacgacgacgtacgtacgtaacgtactacgtacgtacggtacggtaccggacggacg

SEQ ID NO: 366439 - DNA, 537 bp, Homo sapiens
  misc_feature: GZ8MTXP02JYHXX.10.38.D05.1.454.CMB.2.raw
  modified_base (302)..(302): a, c, t, g, unknown or other
  modified_base (351)..(351): a, c, t, g, unknown or other
  modified_base (372)..(372): a, c, t, g, unknown or other
  modified_base (441)..(441): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtccctgagactctcctgtgcagcctctgggttcagcatcagtaacgactacatgacctgggccccnccaggctccgaggggaaggggctgggagtgggtctcgagttatgaaacngatggcactacatattattcngactccgtgaagggtccgttcaccctctccagacgacacttccaaacacatctgtattcttcacgatcncacagttcagagagtacgacgacacggcccaactattatgtcgcgacgactagtcgaactcgactactaacgttcgacggggcccaagggggaccg

SEQ ID NO: 366440 - DNA, 537 bp, Homo sapiens
  misc_feature: GZ8MTXP02I0MVL.10.38.D05.1.454.CMB.2.raw
  modified_base (325)..(325): a, c, t, g, unknown or other
  modified_base (359)..(359): a, c, t, g, unknown or other
  modified_base (368)..(368): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactcctttgttttgaggtcagtaagcggccctcaggntccctgatcggtctctcgcctcagtctggcaacncggcctccngacctctcgtgggctcgagctgaggatgagctgattactactgcagcgcatattcgacgccccaagagggttcgttgggcggtacgggactaacgggtcgaccgttccgtgggtccacgtcccgaacggcctccgccccgtcggtcacctcgtcgttccccaccttccc

SEQ ID NO: 366441 - DNA, 706 bp, Homo sapiens
  misc_feature: GZ8MTXP02GOHHC.10.38.D05.1.454.CMB.2.raw
  modified_base (303)..(303): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctgggccccnccaggctccgaggggaaggggctgggagtgggtctcgagttatagaaaacagatggacactacattattattctagacctccggtaggaacggggtccggttccaaccccgttctacccgaaggacgaactacccttaccaaaacaactacttcgttagtactccttaccgaatatcgactaaactaacgttcgtacggaaacggtacggttacccggaacccgaaccgtaaccccgggtccccttaaaaccctttaagttttaaccgtttgggtaccggacccgggaaccgtaaaccctaaggtttaccggaaacccttaaacccgggtcccttaaaccgttaaaaccggttttcccggggtaccgggggggaacccccttaaaggggggtaacccccccgg

SEQ ID NO: 366442 - DNA, 639 bp, Homo sapiens
  misc_feature: GZ8MTXP02IS70D.10.38.D05.1.454.CMB.2.raw
  modified_base (396)..(396): a, c, t, g, unknown or other
  modified_base (417)..(417): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgacctggccccgcaggctccgaggggaacggggctggagtgggtctcgagttatgaaacagatggacactacatattatctgactcgtagaacgggccgtcaccctntccagacactacttacccaanacatcttgacttctacaactatcgacaactaattccgaggaacgacggttacgaaccgtaaccgaacccgggtacccctaaaaccctttaaagtttacgtttaacgggtcggtacccgtaccggaactaacgttccggtaaaaccctaacccggtcttaaaccgttaaaacgttttcccggggtaccggggggtaaccccgtaaacgggggtaacccccggg

SEQ ID NO: 366443 - DNA, 591 bp, Homo sapiens
  misc_feature: GZ8MTXP02IIX18.10.38.D05.1.454.CMB.2.raw
  modified_base (299)..(299): a, c, t, g, unknown or other
  modified_base (350)..(350): a, c, t, g, unknown or other
  modified_base (399)..(399): a, c, t, g, unknown or other
  modified_base (445)..(445): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggtcagcatcagtaacgactacatgacctgggccccnccaggcctccgaggggaaggggctggagtggggtctacgagttatgaaacngatggacactacatattatctgactccgtgaacgggtccgttcaccctntccaagtacgacacttaccaaacactatccttagacttcttaccanattcgacaactaatccgtagaacgacgtccggaacaacgaccggtaccaaaccgttatttaacgttgcgaccggaccaactatcggaaacctaaccggtacttacgtaaaacgtttccggtacgggggaccccaaagggggccccg

SEQ ID NO: 366444 - DNA, 535 bp, Homo sapiens
  misc_feature: GZ8MTXP02JBLJN.10.38.D05.1.454.CMB.2.raw
  modified_base (301)..(301): a, c, t, g, unknown or other
  modified_base (350)..(350): a, c, t, g, unknown or other
  modified_base (472)..(472): a, c, t, g, unknown or other
  modified_base (506)..(506): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggctcaactggtggagactggaggaggctggatccagccgtggggggtccctgagactctcctgtgcagcctctgggttcagcatcagtaacgactacatgacctgggccccnccaggcctccgaggggaaggggctgggagtgggtctcagttatgaaacngatggcactacattattattctgtactccgtggaacgggtcccggttccacccgttctcccagacgaccaccttaccaaacaactattccttagtactccttacacatgacacaatctgagngtcgacgacacggcctactattatgcgcgcgacntgaactcgctcattcggcgggaccagggg

SEQ ID NO: 366445 - DNA, 550 bp, Homo sapiens
  misc_feature: GZ8MTXP02ISRA6.10.38.D05.1.454.CMB.2.raw
  modified_base (301)..(301): a, c, t, g, unknown or other
  modified_base (456)..(456): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccnccaggctccgaggggaaggggctgggagtggggtctcagttattgaaacagatggcactacatattattctgactccgtgaacgggccggttcaccctcgtccagacgacacttccaaacaacctatcttgatcttacacatcgcacaatctganagtcacgcacgccacctattattgcgcgacgactaacgtctaacctaacgtaccttacgtaaaacgtttcgacgggggacccaagggggacccg

SEQ ID NO: 366446 - DNA, 597 bp, Homo sapiens
  misc_feature: GZ8MTXP02IE2TG.10.38.D05.1.454.CMB.2.raw
  modified_base (452)..(452): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctggttcagcatcagtaacgactacatcgacctgggccccgccacggctccgaggggaaggggctgggagtgggtctcgagttatagaaacagactggacactacatattatctagactccgtgaacggtccgtacaccctctcaagacacctacgttcccaaacaactacttcttagtacttcctcaacctntcgaccaagtaactccgtagacgtacgtccgaacgaaccaccggtacccaaaccgtttattacgtttcggacgtccgacgtaactacgttacgaccgttaacgcttacgtaaacgttccggtacggggaccctaaggggaccccg

SEQ ID NO: 366447 - DNA, 603 bp, Homo sapiens
  misc_feature: GZ8MTXP02F199B.10.38.D05.1.454.CMB.2.raw
  modified_base (321)..(321): a, c, t, g, unknown or other
  modified_base (363)..(363): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccaccaggaccaaacgccccaaactcctttgttttgaggtcagtaagcgcctnagatcctgatcggttctctcgcctaccaagtctcggacaacncggcctccctgacccgtctcgtcgggcctccgagctgagatgaggctagattactactgacagcgcagttacttcgacgaccccaagtacgggtcgtttcggggcggacgggtaacgtaaaggggtcgacccggttccgtcggggtaccacggaccccgaaacggtcccttcccggccccccgttcggggtaccctaccccgttccgttacccgtttaccccccgaacccctttcccccg

SEQ ID NO: 366448 - DNA, 646 bp, Homo sapiens
  misc_feature: GZ8MTXP02JMNMT.10.38.D05.1.454.CMB.2.raw
  modified_base (305)..(305): a, c, t, g, unknown or other
  modified_base (464)..(464): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccnccgaggcctccggaaggggaaggggctgggaggtggggtctcgagttatgaaacagatggacactacattattattctgactccgtgaacgggtccgttccaccctctccaagacgacctacttacccaaacaactacttcttagtacttacttcaacnttacgacctaactaatctaggaagtacgtcgaacgaccgaaccggaccctaacccttaagtttacgtttcggacgaccggtacggtaaacctacgtacggtaaaccgttaaccgggtaccctttaacggtaaaaccgttttccgggtaccggggggacccgtaaacgggggtaaacccccgg

SEQ ID NO: 366449 - DNA, 602 bp, Homo sapiens
  misc_feature: GZ8MTXP02HHE6E.10.38.D05.1.454.CMB.2.raw
  modified_base (417)..(417): a, c, t, g, unknown or other
  modified_base (561)..(561): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtggttcagcatcagtaacgactacatcgacctcgggccccgccgagggccggtccgggggaaggggcgtgggaggtgggtctcgtagttagtagaaacagagtcggacactactattattattctgtactcgtggacgggtccgttcaccctcnccgagacgaccacttaccaaacaactacttcttagtactccttacgacctatcgacctaactaatcgtagaacgacgtacgaaccgaccgaccggaccctaacttagtttatggtcgacgacgtacagtacgtaaccttaccgntaccgtaagttccggacggggaccaacgggggccaccccgg

SEQ ID NO: 366450 - DNA, 628 bp, Homo sapiens
  misc_feature: GZ8MTXP02IWKGZ.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctctgtgcagcctgtgggttcagcatcagtaacgactacatcgacccgtcgggccccgccacgggcctccggaggggaaggggcgtaggggaggttggggttctcgtaagtttaagttagaaaacaggagtggacctaactaactattaatttattcgtagaacctccggtaggaacggggtcccggttaccaccccctcgtaccaagacgacctaaccttaccaaaacaactattacttagtactccttacactatcgaccaacaatcgtagagaacgtcgaaacgaccgaccggacctaaccttattagttgtcgacggacgaccatccgaacttaacgccttaacaacgtttccggacgggggtaccaacggggtaccg

SEQ ID NO: 366451 - DNA, 604 bp, Homo sapiens
  misc_feature: GZ8MTXP02GXWT2.10.38.D05.1.454.CMB.2.raw
  modified_base (241)..(241): a, c, t, g, unknown or other
  modified_base (364)..(364): a, c, t, g, unknown or other
  modified_base (402)..(402): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttataactatgtctctggtaccagcaccaccaggcaaacgcccccaaactcctttgttttgaggtcagtaacgcggccctcaggacgtccctgatcggttctctcgcctcagtctggcaacncggcctcctcgaccgtctcgtgggctccgagctgaggntgagctgtacttactactgacagcgctatacttcgaccggacccccaaaggtacggggttggtttcgggccggggtacgggtaacgttaaacgggtccggtaacccggttcgtcggggtaccaacgggtccccgaaagggtcccttccggccccccgttggtaccctaccgttccgttccgttaccccctaccctttccccg

SEQ ID NO: 366452 - DNA, 561 bp, Homo sapiens
  misc_feature: GZ8MTXP02IDO4C.10.38.D05.1.454.CMB.2.raw
  modified_base (234)..(234): a, c, t, g, unknown or other
  modified_base (323)..(323): a, c, t, g, unknown or other
  modified_base (332)..(332): a, c, t, g, unknown or other
  modified_base (437)..(437): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggaaccagcagtntactttgttgcttaataacttatgtctctggtaccagcaccaccagacaaacgccccaaactcctttgttttgagtcagtaagcgcctnaggactccngcttcgtctctcgcctacagtctggaccaacgccggcctccctcgaccttcctcgtacgggcctccgaggctagaggatgaggtctagtaacttactactgaccngcatatactacgaccgacccgtaaggtgggttcgtcgggcggtacggtacgtaggtcgaccgtcgtcggtacgacgaccgacgtccgtccgcccgtcgtactcctcgtccgtaccctaccctcc

SEQ ID NO: 366453 - DNA, 585 bp, Homo sapiens
  misc_feature: GZ8MTXP02H6R9X.10.38.D05.1.454.CMB.2.raw
  modified_base (475)..(475): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctattttcaaaaggtgtccactgtgaggttcaactggtggagactggaggaggctggatccagccgtgggggtccctgagactctcctgtgcagcctcgtgggttcagcatcaagtaacgactaacatcgaccgtcgggccccgccgacgggctccgaaggggaaggggctgggagtgggtctcgagttattagaaacgagatggacactaacattattattctcgactccggtgaacgggtcccgttacacccctctaccagacgactaccttacccaaactacattcttagtattcttacacagtacncaacattcgtagaagacgtcgacgaccacggccctaacctattacgttgtcgacgccgacactagacctaacgcctacgtaacgtttcggcggggaccgtaagggccccg

SEQ ID NO: 366454 - DNA, 593 bp, Homo sapiens
  misc_feature: GZ8MTXP02JTHZX.10.38.D05.1.454.CMB.2.raw
  modified_base (352)..(352): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctcgggccccgcaggctccgaggggaaggggctggagtgggtctcgagttatagaaacngatggcactacatattatctgactcgtgacgggccgtcaccctctcccagacgacaccttacccaaacaacattccttagtacttcttacactatcgactaacaatctagaagacggtacgacgtaccgaccggtacccaaccttattacgttggtacgccgaccggaacacgttacggaaccttaaccggaccttaccgtaaaacgtttccggtacgggggacccgaaggggaaccccgg

SEQ ID NO: 366455 - DNA, 618 bp, Homo sapiens
  misc_feature: GZ8MTXP02HABB3.10.38.D05.1.454.CMB.2.raw
  modified_base (304)..(304): a, c, t, g, unknown or other
  modified_base (470)..(470): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacatcgacctcgggccccncgaggcctccggaggggaaggggctgggagtgggtctcagttaatagaaacagacgtggactactacattattacttcgtgaccgtccggtaggaacggggtcccgttccaaccccttctaccgaaggtacaacctaccttacccaaaactaacctattcctttanacttccttacactagtcacaacaatctagaagaggtcgaaacgccgaacgtccccaacgtttattacgttcggcgacggaccgactagtccggtaacctaaccgtcttaacgaacggtttccggacgggggacccaagggggaccccg

SEQ ID NO: 366456 - DNA, 584 bp, Homo sapiens
  misc_feature: GZ8MTXP02JNII0.10.38.D05.1.454.CMB.2.raw
  modified_base (354)..(354): a, c, t, g, unknown or other
  modified_base (482)..(482): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcaggtaacgactacatgacctgggccccgccaggctccgaggggaaggggctgggagtggggtctcgagttattgaaacngactggacactacatattattctgactccgtgaacggggtccgttcaccctctacagtagaccacttacccaaacacctattaccttgtactcttacacgtatcgacacaatctagagagtccgaacncgaaccggccctaacccgtatttagtttcggacgtcgactaactactcggtaaccttaacgccttaccaaacgttcggtcgggggacccacgggggaacccg

SEQ ID NO: 366457 - DNA, 631 bp, Homo sapiens
  misc_feature: GZ8MTXP02HXYUJ.10.38.D05.1.454.CMB.2.raw
  modified_base (383)..(383): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctcgtgggttcagcatcagtaacgactacatcgacctcgggccccgccgacggcctaccgaggggaaggggctgggaggtgggtctcgagttatagaaacagatggacactacattattattcngtactcgtgaacgggtccgtacaccctctaccaagacgactaccttaccaaaacacctattcttagtactcttacgacatcgacaacaagttctaggacgaacgtaccgaacgaaccgaccggaacccctaaaccgtttatttaacgtttcggacgaccggacccgtaactaacgttacgaaacccttaaccggaccttaactaaaacggtttccggacggggggaacccctaacgggggtaaccccg

SEQ ID NO: 366458 - DNA, 683 bp, Homo sapiens
  misc_feature: GZ8MTXP02HKQFD.10.38.D05.1.454.CMB.2.raw
  modified_base (268)..(268): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagccttttttcgnggggttcagcatacagtaacgactacatcgaccgtcgggccccgccgagggcctcccggaagggggaacggggccgtaggggaggttcggggttaccttacgtaaggtttaattaggaaaacgaggtacgtcgggacctaactaactaatttaactttaacttcgtacggtaccgttcccgggtagggtaaaccgggggtccccggttaccctacccccgttcctacccgaaaggacgaaccctacccttacccaaaacacctacttacgtttatacttcttacaactagtcgactacaatccgtagagtacgacgacgaccgaccgaccctaacgttatttacgtggtcgcgtacgacctagtcgaaccttaacgcttacgtaaacgttcggacggggaccgtaaggggacccg

SEQ ID NO: 366459 - DNA, 578 bp, Homo sapiens
  misc_feature: GZ8MTXP02HSMGC.10.38.D05.1.454.CMB.2.raw
  modified_base (419)..(419): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctcgggccccgccaggctccgaggggaaggggctgggagtgggtctcgagttacttagaaacagatggcactacattattattctgactccgtagaacggggccggttccaccctctaccaagganacctacttacccaaaactaaccattccttagtacttcttacactagtcacaactaatctagagtagtaccggaacaccgaccgaccctacttaatttacgtttgcgcggaccacatacgactaacgctacctaagtcggtacggggccaagggggaccc

SEQ ID NO: 366460 - DNA, 495 bp, Homo sapiens
  misc_feature: GZ8MTXP02G5BQ3.10.38.D05.1.454.CMB.2.raw
tcagcatagtagtgcacgaccggtgctcgatttagtatctgatagttgggtttgggggtctcaggaggcagcgctctcaggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggtccctttggggatttctaatcgcttctctgcctcaagtctggcaacacggcttccctgaccatctccgggctccacgctgagacgaggctcattatactgcagctcatatacaccaggggcactctcgtgatacgttcggcggacggacctggctcgaccgtcctacgtcacgacccg

SEQ ID NO: 366461 - DNA, 651 bp, Homo sapiens
  misc_feature: GZ8MTXP02F7BL1.10.38.D05.1.454.CMB.2.raw
  modified_base (450)..(450): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggactccgacggccggtcgggggtcctgagactctctgtgcacgtctcgtggtcagcatacaagtaacgactacagtcggaccgtcggccccgccgacgggccgtacggaggggaaggggtcgtagggtaggtcgggtctacgtagtttaacgtaggaaaactagacgtacggacctaactaactatttacttattctcgacgtcggtacggaaccgggtcccgttaccncccttcacgacaacgaacctaccttaacccaaacactacttccgttatacttccttacacgtatcgacaacgtaatcgtagacgtacgacgaacgaccgaccgtaccaacctttagttacgttcggcgtacgacgtaactacgtaccgtaacgtaacgtaccttacgtacggttccggacggggccccgaaggggtacccg

SEQ ID NO: 366462 - DNA, 603 bp, Homo sapiens
  misc_feature: GZ8MTXP02F3W1L.10.38.D05.1.454.CMB.2.raw
  modified_base (366)..(366): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcagcctcgtgggttcagcatcagtaacgactacatcgacccgtgggccccgccgaggcctaccggaggggaacggggcgtgggaggtcgggtctcgtagttatagaaacngatcgacactactattattattcgtcgacgtcgtaggtaaccgggtccgttaccaccctctccgaaggacacctaccttaccaaacactattcttagtactcttacacagtcacaactatctagacgtacgaccgaacgaccaccggtcctaacttaatttcgtaggtcacggtacaacctagtacgaacctaacgccttaacgtaacggttcggaccggggaccgacgggtacccg

SEQ ID NO: 366463 - DNA, 552 bp, Homo sapiens
  misc_feature: GZ8MTXP02IBF51.10.38.D05.1.454.CMB.2.raw
  modified_base (303)..(303): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttccttgttgctatttcaaaaggtgtccactgtgaggttcaactggtggagactgggaggaggctggatccagccgtggggggtccctgagactctcctgtgcagcctctgggttcagcatcagtaacgactacatgacctgggccccnccaggctccgaggggaaggggctgggagtgggtctcagttatgaaacagatggcactacatatttattctgactccgtgaacgggtccgttcaccctctccagagacacttccaaacacattctgtatcttacactatcgcacaagttcagagagtcgaacgacacggccctaactattagttcggcgccgacgacagtcgaacctaacgcctacgtaaacgttccggacggggaccaacggggacccg

SEQ ID NO: 366464 - DNA, 532 bp, Homo sapiens
  misc_feature: GZ8MTXP02FPL25.10.38.D05.1.454.CMB.2.raw
  modified_base (300)..(300): a, c, t, g, unknown or other
  modified_base (348)..(348): a, c, t, g, unknown or other
  modified_base (369)..(369): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccncaggctccgaggggaaggggctgggagtggggtctcagttatgaaacngatggcactacatattattcngactccgtgaacgggccggttcaccctctccagagacacttcccaaacaacatcttgtatcttcacatgcacaatctgagagtcgacgacaccggccaacctattactgtacgcgcgacatcgactaacgctactaacgtttcgacgggggccaggggacccg

SEQ ID NO: 366465 - DNA, 632 bp, Homo sapiens
  misc_feature: GZ8MTXP02G26KJ.10.38.D05.1.454.CMB.2.raw
  modified_base (301)..(301): a, c, t, g, unknown or other
  modified_base (351)..(351): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggccccnccaggcctccgaggggaaggggctgggagtgggtctcagttatagaaacngatggcactacattattatctgactccggtagaacggggtccgtttacaccccgtctccaagacgacctaccttacccaaactaaccattccttagtactcttacaacgtatgaccaacaatcgtagagtacgtccgaaccgtacgaccggccctaaccgtttaattacgttcggtacgacccgggactaaccgtagttcggtaaaacccttaaccggaccttaaccggttaaaacgttttccggggtccgggggaacccccgaaaaggggggttcccccg

SEQ ID NO: 366466 - DNA, 571 bp, Homo sapiens
  misc_feature: GZ8MTXP02IGB3J.10.38.D05.1.454.CMB.2.raw
  modified_base (222)..(222): a, c, t, g, unknown or other
  modified_base (271)..(271): a, c, t, g, unknown or other
  modified_base (436)..(436): a, c, t, g, unknown or other
  modified_base (476)..(476): a, c, t, g, unknown or other
  modified_base (518)..(518): a, c, t, g, unknown or other
  modified_base (532)..(532): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcactggtggagactggaggaggcgtgganccagccgtcgggggtccgtgagactctcctgtgcacgcctcgtggttcngcatcagtaacgacacatgacctcggccgccgaggctccgaggggaggggcgtggagtgggtctctagttatagaaacagagtgacactacattattattcgtcgactccggtagtaacgggtccggttcctaccctctaccgagaagacctacttaacccaaanaacctattcgttatactcttacactatgacctacaatcgngtagacgtcgaacgtacaccggtcctaacttattgttacgcncggactactaagtnaccgtaacgtctctaacgttcgtcggggactaggacccg

SEQ ID NO: 366467 - DNA, 538 bp, Homo sapiens
  misc_feature: GZ8MTXP02FM6KR.10.38.D05.1.454.CMB.2.raw
  modified_base (301)..(301): a, c, t, g, unknown or other
  modified_base (347)..(347): a, c, t, g, unknown or other
  modified_base (427)..(427): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccncaggctccgaggggaggggctgggagtgggtctcagttatgaaacngatgcatacatattattctgactccgtagaacgggccgttcaccctctccagacgacacttacccaaacaactatcgttntacttcttacacatcgacacaatctagagacgtcgaacgactaccggccaactattatgtcgcgacgacatcgaactaacgctacaacttcgacgggggaccaggggaccg

SEQ ID NO: 366468 - DNA, 652 bp, Homo sapiens
  misc_feature: GZ8MTXP02ISJD1.10.38.D05.1.454.CMB.2.raw
  modified_base (520)..(520): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaggtgtccactgtgaggttcaactgggtggagacgtggaggaggctggatccagccgtgggggtccctgagactctcctgtgcacgcctcgtggttcagcatacaagtaacgacacagtcgaccgtcgggccccgccgaggcctaccggaggggaaggggcgtagggaggttgggtactacgtagttagttagaaacagactggacctaactactattaactttacttcgtgtaccgttccgtagggtaaccgggggtcccgtttacaccttccctactacccaaggaacacctaccttaaacccaaactaaacctattcgttatacttaccttacaactagttanaaccaactaactcgttagaacgtacggtaccgaaccgaccgtaccggaacccttaacgttagtttagttcgacgcgtacgactagtacgtaacgtacgacttacgtaacttcggtacgggggaccaacgggg

SEQ ID NO: 366469 - DNA, 583 bp, Homo sapiens
  misc_feature: GZ8MTXP02F6E2W.10.38.D05.1.454.CMB.2.raw
  modified_base (222)..(222): a, c, t, g, unknown or other
  modified_base (269)..(269): a, c, t, g, unknown or other
  modified_base (308)..(308): a, c, t, g, unknown or other
  modified_base (313)..(313): a, c, t, g, unknown or other
  modified_base (355)..(355): a, c, t, g, unknown or other
  modified_base (374)..(374): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcagttattgaaacngatggcactacatattatctgactccgtgaagggccgttcaccctcnccagagacacttccaacacatctgtatcttcacatgcanaatcngagagtcgacgacacggccaacccttattattgtgcgcgacntgactacgctcaatttcgnggggccaggggacgcccgaggtccacccgtcctccccagccctaccacccgaacgggcccctacgtccggttcccttcccccgtcgggcccgtccccgtcgccctaccgacgggaacgtccacccgtccgaacggacgccaacgcggcccggcccgtcggggcctcggcccgtggtaccaacggtacctccgttacccacttacctacg

SEQ ID NO: 366470 - DNA, 574 bp, Homo sapiens
  misc_feature: GZ8MTXP02FRQ5X.10.38.D05.1.454.CMB.2.raw
  modified_base (301)..(301): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcagtaacgactacatgacctgggccccncaggctccgaggggagggctgggagtgggtctcgtagttatagaaacagatggcaactacatattattcagactcgtagaacgggtccgttccaccctctcagacgacacttaccaaacactattccttgtacttcttacaacatcgacaactaatctagagacgtccgaacgaccgacggtccctaacttattacgttgtcggacgacgaacctagtcgaaccgtaacgccttactaaacgtttccggacgggggacccaagggggaccccg

SEQ ID NO: 366471 - DNA, 561 bp, Homo sapiens
  misc_feature: GZ8MTXP02FOBD5.10.38.D05.1.454.CMB.2.raw
  modified_base (300)..(300): a, c, t, g, unknown or other
  modified_base (344)..(344): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtccctgagctctcctgtgcagcctctgggtcagcatcagtaacgactacatgacctgggccccncaggctccgaggggagggctggagtgggtctgagttatgaaacngatggcactacatattattctgacttcgtgaacgggtccgttcaccctctaccagacgaccacttaccaaacaacatcttgtatcttacactatcgacaactaatctagagtacgtcgaaccgacaccggaccctaacccttaattacgttgtacgaccgtacgaactactgaccttaacgctacaaacgttcgtacgggggacccaaggggacccg

SEQ ID NO: 366472 - DNA, 639 bp, Homo sapiens
  misc_feature: GZ8MTXP02HBAO8.10.38.D05.1.454.CMB.2.raw
  modified_base (256)..(256): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtcactgtgaggttcaactggtggagactggaggaggctggatccagccgtgggggtccctgagacctctcctgtgcncgcctcgtggttcagcatcaagtaacgactacatcgaccgtcgggccccgccgacggcctaccggaaggggaacggggcgtgggaggtgggtctcgtagtttaagtagaaacagacgtcggacactaactattagttacttcgtcgtaaccgttccggtagggaaccggggtcccggttaccctaccccgttcctaccgaaggacaacctacccttaacccaaaactaactacttacgttataaccttcttacactatacgaccaactaattccgagacgacggtaccgaaccgaccgacccggtacctaacttaagttcgttggcgcgacgtacagtcgtacctaacgcttacgacgttcggacggggaccgtagggacccg

SEQ ID NO: 366473 - DNA, 626 bp, Homo sapiens
  misc_feature: GZ8MTXP02HV6D1.10.38.D05.1.454.CMB.2.raw
  modified_base (373)..(373): a, c, t, g, unknown or other
tcagcatagtagtgcacgaccggtgctcgatttagtatctgatagttgggtttggggggagaggagcccagcactgtgattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagccctctggggttcagcatcagtaacgactacatgaccgtcggccccgccaggcctccgaggggaggggcgtggaggtgggtctcgagtttatagaaacagatgcactacattattnttctgactccgtagacggggccgttccaccctctccagacgaccacttaccaactaactacttcttagtacttccttacactattacgaccaactaacgtccgtaggaacggtacgtacggaaaccgaccgtaacccgggacccctaaccttagttttaagttcggtacggaccggtacggaaacctaacgtacggtaacccttaacggcctttaaccgaaagtttccggggtacgggggacccgaacggggg

SEQ ID NO: 366474 - DNA, 716 bp, Homo sapiens
  misc_feature: GZ8MTXP02JLA2I.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctctgtgcagcctcgtggtcagcatcaagtaacgactacatcgaccgtcgggccccgccgaggccgtaccggaagggggaacggggcgtggggaggttcggggtccttacgtaggtttaacgttaggaaaaaccgtaggaacgttacgggacctaacttaacgtaattaactttaacttccgtagtacccgttaccgggtacgggaaccggggttcccgtttacccgaccccttaccgtcccgaaagggtaccaaacctaccttacccaaaactaccaatttccttagtacttcttacgactagtacgaccataactcgtaaggaacgtacggtacgaaccgaaccgacccggtaccctaaccgtttaattacgttcggtacggccgaaccggtactaacgtcgaaaccgttaacggccttaaacctaacggtttcccggacgggggaccccgaaaggggtacccccgg

SEQ ID NO: 366475 - DNA, 597 bp, Homo sapiens
  misc_feature: GZ8MTXP02J0PEA.10.38.D05.1.454.CMB.2.raw
  modified_base (355)..(355): a, c, t, g, unknown or other
  modified_base (420)..(420): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctgtaccagcaccaccagacaaacgccccaaatcttgttttgagtcagtaagcggcctcaggacgtcctgactcggttctctcgcctcagtctggacaacnccggcctccctgacccgtctcgtcgggcctccgaggctgagatgaggctagtacttactactcgnagcgctatattcgacggccccaaacggtaggggttggtttcgggcgggtacggggtaacgtaaaggggtcggacccggttcggtcggggtaccaccgggacccgaacgggtcctcccgggcccccgttcgggtccctaccgttcccgttacccggtttcccccgacccctttccccg

SEQ ID NO: 366476 - DNA, 588 bp, Homo sapiens
  misc_feature: GZ8MTXP02F218Q.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccaggccgtggggggtccctgagactctcctgtgcagcctctggggttcagcatcagtaacgactacatgacctgggccccgccaggctccgaggggaaggggctgggaggtgggtctcgtagttacttgaaaacagactggacaactactataatttattctgtacgtccggtacggaacggggtcccggttccaccctcctccagacgacaccttacccaaacaactatcttgactcttacacatcacacaatctagagtacggtaccgaacgaccaccggtaccctaacctaatttacgtgtcgacgacgacaacgtcgtaccaacgtctacgtaacttccggacggggccgacggggacccg

SEQ ID NO: 366477 - DNA, 547 bp, Homo sapiens
  misc_feature: GZ8MTXP02JA9DA.10.38.D05.1.454.CMB.2.raw
  modified_base (347)..(347): a, c, t, g, unknown or other
  modified_base (392)..(392): a, c, t, g, unknown or other
  modified_base (410)..(410): a, c, t, g, unknown or other
  modified_base (414)..(414): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgcaggctccgaggggaagggctgggagtgggtctcagttatgaaacngatggcactacatattatctgactcgtgacgggtccgtcaccctnccagacacacttccaaanactntcttgtactcttacacgtatcgacacaattcagagacgtcgaacgacgaccgcctaacttattagtgtacgcgcaactagtcgaactaaccgcttacgtaaacgtttcggacgggggaccctaaggggacccg

SEQ ID NO: 366478 - DNA, 597 bp, Homo sapiens
  misc_feature: GZ8MTXP02IL5PM.10.38.D05.1.454.CMB.2.raw
  modified_base (327)..(327): a, c, t, g, unknown or other
  modified_base (358)..(358): a, c, t, g, unknown or other
  modified_base (396)..(396): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttatactatgtctctgtaccagcaccaccaggcaaagcccccaaactccttgtttgagtcagtaagcggccctcaggacgtcccngactcggtctctcgcctcaagtctggcaacncggtcctccctgacccgtctcgtgggctccagctgagntgagctgattacactgcagcgctatattcaaccggcccccaaaagcggggtttgtttcgggccggtacggggtaacgtaaacgggtcgtaacccggtccgtacgggggtacaacggccccgtaaaacgggtcccttaccggccccccgttacgggtaccctaccggttaccttcccggtttcccccaaccctttacccccg

SEQ ID NO: 366479 - DNA, 546 bp, Homo sapiens
  misc_feature: GZ8MTXP02FR925.10.38.D05.1.454.CMB.2.raw
  modified_base (362)..(362): a, c, t, g, unknown or other
  modified_base (419)..(419): a, c, t, g, unknown or other
  modified_base (423)..(423): a, c, t, g, unknown or other
  modified_base (439)..(439): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggcccgcaggctccgagggagggctgggagtgggtctcgagttatgaaaccagatggcactacatnttatctgactccgtagaacgggccgttacacccgtctccagacgactactcccaaanaacntctgtaatcttcactntgacctaacaactgtagagtacgtccgaacgaccaaccggacctaaccttatttacgtgtcgacgtacgaacatgacctaacgctacaaactttcggaggggacccg

SEQ ID NO: 366480 - DNA, 550 bp, Homo sapiens
  misc_feature: GZ8MTXP02FJ4WS.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtgggccccgccaggctccgaggggaggggctgggagtgggtctcgtagttatagaaacagatggcactacatattatctgactcgtgaacgggtccgttcaccctctccagacgactacttacccaaacaacctattcttagtaactccttacactatcgacactaatctagagacgtacgacgacaccggcctaactattatgtcgcgacgacatcgaacaacgctacgaacgttcgcggggaccaggggaccc

SEQ ID NO: 366481 - DNA, 543 bp, Homo sapiens
  misc_feature: GZ8MTXP02JTYZY.10.38.D05.1.454.CMB.2.raw
  modified_base (348)..(348): a, c, t, g, unknown or other
  modified_base (370)..(370): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgcaggctccgaggggaaggggctggagtggggtctcagttatgaaacngactggcactacatattattcngactccgtagaaggggccgtttcacccctctcccagacgacaccttccaaacaacatcttgtatcttacactatcgacaactaagtctagagagtcgaacgacacggccaccgttatagttgacgcgacgacagtcgaactaacgctacaacttccgcggggaccaggggacc

SEQ ID NO: 366482 - DNA, 645 bp, Homo sapiens
  misc_feature: GZ8MTXP02GKHJW.10.38.D05.1.454.CMB.2.raw
  modified_base (356)..(356): a, c, t, g, unknown or other
  modified_base (447)..(447): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccagccgtgggggtccctgagactctcctgtgcagcctctgggtcagcatcagtaacgactacatcgacctcgggccccgccaggcctaccgaggggaagggctgggagtgggtctcgtagttatagaaacngatggcactacattattattctagacttccggtgaacgggtcccgttccaccctctacccaaggacacctaccttacccaaaactaacctnttcctttagtactcctttaccaactatcgacctaacaattccgagaacggagtcccggaaacgaccgaccggtacccctaaacctttagtttaaccgtttggaccggacggtaccgaacctaagtcggtaaacccctaacggaccctttacgtaaaacgtttcccgggacggggggacccccaaaggggggtaccccc

SEQ ID NO: 366483 - DNA, 558 bp, Homo sapiens
  misc_feature: GZ8MTXP02GWHAQ.10.38.D05.1.454.CMB.2.raw
  modified_base (302)..(302): a, c, t, g, unknown or other
  modified_base (348)..(348): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctctgggttcagcatcagtaacgactacatgacctgggccccncaggctccgaggggagggctgggagtgggtctcagttatagaaacngatgcatacatattatctgactcgtgaacgggccgttcaccctctaccagacgaccacttacccaaacaactattcttagtacttcctttacaactattcgaccaacaatctaagagacgtaccgaaaccgaccacggacccaaccttaattacgttgtcggctacgacaatcgaactaacgctacaacttcgcggggaccaggggaccg

SEQ ID NO: 366484 - DNA, 564 bp, Homo sapiens
  misc_feature: GZ8MTXP02G9HOO.10.38.D05.1.454.CMB.2.raw
  modified_base (303)..(303): a, c, t, g, unknown or other
  modified_base (415)..(415): a, c, t, g, unknown or other
  modified_base (440)..(440): a, c, t, g, unknown or other
  modified_base (456)..(456): a, c, t, g, unknown or other
  modified_base (461)..(461): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccncaggctccgaggggaaggggctgggagtggggtctcgagttatgaaacagatgcactacatattatctgactccgagacgggccgtcaccctctcagagacacttcccaaanacctatcttagacttcttacaacgntgaccaacaattccgngaagngtacgaacgaccgtacggcccaaccgttaattatttcggtcgccgcggacctagttcgaacttaacccgctacgtaacgttcggacggggaccgacgggaccg

SEQ ID NO: 366485 - DNA, 616 bp, Homo sapiens
  misc_feature: GZ8MTXP02GZW2Q.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcagtaacgactacatcgaccgtcgggccccgccgagggcctaccggaaggggaacggggcgtgggaggttcggggtctacgtagtttaatagaaactagacgtggactactacattattatctagactccggtaggaacgggtccggttaccaccccttctaccaacggtacaacctaccttacccaaaactactacttcgttatactcttacaactatacacaactactcgagaacgacgtacgaacgacgaccgtacctaacttatacgttgacgctacgactacgtcgtaacctaacgtcctaacgtaacttccgggacgggacccggtaagggaccccg

SEQ ID NO: 366486 - DNA, 611 bp, Homo sapiens
  misc_feature: GZ8MTXP02FYNO8.10.38.D05.1.454.CMB.2.raw
  modified_base (311)..(311): a, c, t, g, unknown or other
  modified_base (352)..(352): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccacccagcaaacgccccaatccttgtttgagtcagtagcgcctnaggactcctgatcggttctctcgcctcaagtctggccaacnccgccctcctgacccgtctcgtgggcctccgaggctgagatgaggctagtacttactactgacacgcgacattacttccgaacggacccccgtaaagtagggggttcggtttacggggaccgggtacggggtaacgttaaacgggtcgtacccggttcccgtgggggtacccaacggaccccgtaaacggcccgttaccggccccccgttcgggtaccctacccgttccgttcccggtttcccccgtcccctttccccg

SEQ ID NO: 366487 - DNA, 594 bp, Homo sapiens
  misc_feature: GZ8MTXP02G2SLC.10.38.D05.1.454.CMB.2.raw
  modified_base (302)..(302): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctgggccccncaggctccgaggggaaggggctggagtggggtctcgtagttattgaaacagatggacactacattattattctgtactccggtagaaacggggtcccgttacaccccgtctcccgaagacgaccaccttacccaaacaactatcttagtactcttacaacatacgacaacgtaactacctagagacgtacgaacgaccgaccggaccctaacccgttattacttggtacgcgcgaacacgtcgaacctaacggtacctacgaaattccgtacggggaccgtacggggaaccg

SEQ ID NO: 366488 - DNA, 648 bp, Homo sapiens
  misc_feature: GZ8MTXP02I1TV8.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcaagtaacgactacatcgaccgtcgggccccgcaggctccgaggggaaggggctgggagtgggtctcgtagttatagaaacagactgactaactactattattattcgtagtacctccggtaggaaccggggtcccggttaccaccccgtctacccgagaacgaacctaccttaccaaaactaactattcttagtactcttacaactatcgaccaactaatctaggacgagtccgaaacgaccgaccggtaccctaactttaagtttacgttggtacggaccgtacggtaactaacgtacggtaaaccctaaccggtaccttaacgttaaaacggtttcccggaacgggggaccccgtaaacgggggtaacccccg

SEQ ID NO: 366489 - DNA, 594 bp, Homo sapiens
  misc_feature: GZ8MTXP02JFQ2O.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctatttcaaaaggtgtccactgtgaggtttcaactggtggagactggaggaggctggatccagccgtggggggtccctgagactctcctgtgcagcctctgggttcagcatcagtaacgactacatgacctgggccccgcaggctccgaggggaaggggctgggagtggggtctcgagttattgaaacagatggcactacattacttattctgactccgtgaacgggccggttcacccctgtcccagacgacacttaccgaaacacatcttgtatcttacacatgacacgaatcctaggacgtagtcggaacgaccgaccgggaccctaacccttaaatttcgtttacgtcgggacggttacgaacgtactcggtaacctaacggtcctaactaaaccgtttcgtacgggggaccctaaggggaacccg

SEQ ID NO: 366490 - DNA, 585 bp, Homo sapiens
  misc_feature: GZ8MTXP02II1TL.10.38.D05.1.454.CMB.2.raw
  modified_base (411)..(411): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtggttcagcatcagtaacgactacatgaccgtcggccccgccaggcctaccgaggggaaggggcgtgggagttgggtcttcagttatagaaacagagtggacactactattattattctgactccgtagacgggtccgtaccaccctcnccagacgactaccttacccaaacacattcttagtactctttacactatcgacactaatcagaagacgtacgacgaacaccggcctaaccttagtttattcggtacgccgacgtaccaagttcgaaccttaacttctacgtaaacgttcgtacgggggacccaagggggtacccg

SEQ ID NO: 366491 - DNA, 631 bp, Homo sapiens
  misc_feature: GZ8MTXP02IJYBZ.10.38.D05.1.454.CMB.2.raw
  modified_base (365)..(365): a, c, t, g, unknown or other
  modified_base (423)..(423): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactgggagggaggctggatccgagccgtgggggtccctgagactctcctgtgcagcctcgtggttcagcatcaagtaacgactacatcgaccgtcgggccccgccgaggcctccggaaggggaaggggctgggaggtgggtctcgagtttatagaaacngactggcactacattattacttctgacctccggtagacgggggtccgttccacccctntaccagacgaccacttacccaaacacctattcttagtactcttaccaactatacgaccaactaattccgtaggaagtacgtaccgaaccgtaacgacccgggccctaaactttaactttagttcggtacgaccggacgaactaacgtttcgaaaccttaacggtccttacgtaaacgtttccgggcgggggacccctaagggaccccg

SEQ ID NO: 366492 - DNA, 622 bp, Homo sapiens
  misc_feature: GZ8MTXP02H7WU2.10.38.D05.1.454.CMB.2.raw
  modified_base (264)..(264): a, c, t, g, unknown or other
  modified_base (305)..(305): a, c, t, g, unknown or other
  modified_base (351)..(351): a, c, t, g, unknown or other
  modified_base (378)..(378): a, c, t, g, unknown or other
  modified_base (449)..(449): a, c, t, g, unknown or other
tcagcatagtagtgcacgaccggtgctcgatttagtatctgatagttgggttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactgggaggaggctggatccgagccgtgggggtccctgagactctcctgtgcagcccttntgggtcagcatcagtaacgactacatcgaccgtcgggcccncaggctcgaggggagggctgggagtgggtctcgagttatagaaacngactggctaactactattattacttcngtaactccggtagggaaccgggtcccggttaccaccctcctaccagacgacctacctacccaaactaactnttacttacttataccttacacctatacgaccactaatcgtagaacgtacgtaccgaacgaccgaacggtaccctaacgtttaaattacgtttcggacgaccgtcgaaacgtattacggaacctaaccggctaaccgtaaacgtttcgggacccggggaccaaacggggccccg

SEQ ID NO: 366493 - DNA, 562 bp, Homo sapiens
  misc_feature: GZ8MTXP02IXUC9.10.38.D05.1.454.CMB.2.raw
  modified_base (352)..(352): a, c, t, g, unknown or other
  modified_base (439)..(439): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattttcaaaaggtgtccactgtgaggttcaactggtggagactggaggaggctgaatccagccgtggggggtccctgagactctcctgtgcagcctcgtgggttcagcatcagtaacgactacatgacctgggccccgcaggctccgaggggaaggggctgggagtggggtctcgagttatgaaacngactggcactacatattatctgactcgtagacgggtccgttcaccctctcagacacacttacaaacactatcttgtatcttacactntcgcactatctgagagtcgaacgacaccggcctaaccttattacgtaggtcgccgacgaacaacgttcgaaccgttaaccgtctacctaaacgtttcggacggggcccgtaagggggaccccg

SEQ ID NO: 366494 - DNA, 670 bp, Homo sapiens
  misc_feature: GZ8MTXP02G9TFU.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctctgtgcagtcctcgtggtcagcatacacgtaacgactacagtcgaccgtccgggccccgccgacggccgtaccggaaggggaaggggcgtgggaggtcgggtctacgtagttaagtagaaacgagacgtgactactaactattattacttctacgtaccgtccggtaggaaccggggtcccgttccaccctctccgaaggacaacctactaacccaaatactcttctagtacttccttacactagtctaacaactaacgttcgaggaacgtacggtaccgaaacgtacccacccggtaccctaacgtttaactttagttcgggacgccggtaaccacgtaacgtaccgaaaccgtttaaccggccttaaacccgttaaacgggttccccgggtacgggggaccccggtaaagggggtcccccg

SEQ ID NO: 366495 - DNA, 554 bp, Homo sapiens
  misc_feature: GZ8MTXP02JYBW7.10.38.D05.1.454.CMB.2.raw
  modified_base (353)..(353): a, c, t, g, unknown or other
  modified_base (462)..(462): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggcctccgaggggaaggggctgggagtgggtctcgagttattagaaacngatggcactacatattattctgactccgtagaacgggtccggttcaccctctaccagacgacacttacccaaacaacattcttgtacttcttacacatcgacaacatcngagacgtcgacgacacgccaacttatacttggcgcgcgacacgttcgaacctaacgcttacaaacgtttcggacggggaccgaaggggcccg

SEQ ID NO: 366496 - DNA, 606 bp, Homo sapiens
  misc_feature: GZ8MTXP02IANNJ.10.38.D05.1.454.CMB.2.raw
  modified_base (301)..(301): a, c, t, g, unknown or other
  modified_base (349)..(349): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctggtcagcatcagtaacgactacatgacctcggggccccnccaggctccgaggggaggggctgggagtgggtctcagttatagaaacngactggcactacattattattctagtactccggtaggaacggggtccccggtttcaacccccttctacccgagacgaacctacccttacccaaaacaacctattccttagtactccttacactatcgacaacaatcctagaagacgtcgaacgtacaccggccctaacttattacgttgtcgaccggacacctagttacgaaccgttaaccggccttaacgtaaacgtttccgggcgggggacccaacgggggaccc

SEQ ID NO: 366497 - DNA, 532 bp, Homo sapiens
  misc_feature: GZ8MTXP02FUCTN.10.38.D05.1.454.CMB.2.raw
  modified_base (348)..(348): a, c, t, g, unknown or other
  modified_base (377)..(377): a, c, t, g, unknown or other
  modified_base (397)..(397): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctggagtgggtctcagttatgaaacngactggcaactacatattatctgactcgngaacgggtccgtcaccctcncagacacacttccaacacatcttgtactcttcacatcgacacaatctgagacgtcgacgacaccgccaacctattacttgtcgccgcgacagtcgactaaccgctactaacgttcgtacgggggccaggggaccg

SEQ ID NO: 366498 - DNA, 621 bp, Homo sapiens
  misc_feature: GZ8MTXP02HRNPV.10.38.D05.1.454.CMB.2.raw
  modified_base (262)..(262): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctntgggtcagcatcagtaacgactacatcgacctcgggccccgccgacggcctccgaaggggaaggggctgggaggtggggtctcgagttattgaaacgagacgtggactactaacattaattacttcgtagtacctccggtaggtaaccgggggtcccgttaccacccctctacccgaaggacaacctaccttacccaaacaactacttacttagtactcttactactatcgacaactaactctagacggtagtaccgaaccgaccgaaccggaccctaaccgttaatttacttggtcgacgacgactagtacaaccgtaacgctaacgtacgttcggaccggggaccaggggaaccccg

SEQ ID NO: 366499 - DNA, 586 bp, Homo sapiens
  misc_feature: GZ8MTXP02JNFYZ.10.38.D05.1.454.CMB.2.raw
  modified_base (352)..(352): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgaccgtgggccccgccaggctccgaggggaaggggctgggagtggggtctcgagttatagaaacngatggcactacatattatctgactcgtgaaggggtccgttcaccctctccagacgacacttacccaaactacattccttagtactcttacactatcgtacaactaactctagagacgtcgacgaaccacggaccctaaccttaagttacgttcgtacggacgtacgaacctagtacgaaccgtaacgcccttaacgtaaacgttcggtacgggggacccgaacgggggtacccg

SEQ ID NO: 366500 - DNA, 443 bp, Homo sapiens
  misc_feature: GZ8MTXP02IXA5L.10.38.D05.1.454.CMB.2.raw
  modified_base (435)..(443): a, c, t, g, unknown or other
tcagcatagtagtgcacgaccggtgctcgatttagtatctgatagttgttggaagtgtctctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcgtggggccagggagcccaggtcaccgtctccccacgcctccaccaacgggccccatcggtccttccccctggccgcccctgcctccgaggacgccacctccgagacgcaccgacgccgcccgtgggctcgcctgggtcaaacggacctaccttcccactactactgctggacgcggggctggacaagggcgcagtagnnnnnnnnn

SEQ ID NO: 366501 - DNA, 700 bp, Homo sapiens
  misc_feature: GZ8MTXP02JAXTZ.10.38.D05.1.454.CMB.2.raw
  modified_base (242)..(242): a, c, t, g, unknown or other
  modified_base (375)..(375): a, c, t, g, unknown or other
  modified_base (419)..(419): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtncttataactatgtctcctggtaccacgccaccacccaggaccaaacgccccctaaacttcctttgttttgacgttcagtaacgccggcctcaggcgtcctgtagtcgttctctcgcctcaagtctggacaacnccggcctcctcgaccctctcgtcgggctccgaggtctaggacgntcgaggtctaggtaacttaccgtacgtgacgagccgactatacgttacccggaccggtaaccccctaaaggtacgggggtttcggtttacggggacccgggggtacggggtaaacgttaaacggggttccgggtaaccccggtttcccgggtacgggggtaacccaccgggtacccccggaaacggggttccctaccccggggtcccccgttacccgggggttaccctaacccggtttccccgtttacccggtttaccccccgtaccccgtttaccccccg

SEQ ID NO: 366502 - DNA, 585 bp, Homo sapiens
  misc_feature: GZ8MTXP02JWWBK.10.38.D05.1.454.CMB.2.raw
  modified_base (446)..(446): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctgtgggttccagcatcagtaacgactacatcgaccgtgggccccgccacggctccgaggggaaggggcgtgggaggtgggtctcgagttatagaaacagagtggcactacattattattctcgactccgtagaacgggtcccggttccacccctctcccgaagacgacctacttacccaaacaacctnttccttgtactccttacacctatcgacaacaattccgagacgtacgtccgaacgaccaccggacctaccttattacgtggtcgcgtacacactgtaacctgaccttactaacgttccggcggggacccgaggggacccg

SEQ ID NO: 366503 - DNA, 555 bp, Homo sapiens
  misc_feature: GZ8MTXP02F8GW6.10.38.D05.1.454.CMB.2.raw
  modified_base (346)..(346): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctggcccgccaggctccgaggggaaggggctgggagtgggtctcagttatgaaacngatggcactacatattattctgactcgtgaacgggtccggttacaccctctccagacgaccacttacccaaacaaccattcctttagtactctttacacattgccaacaatctagagacgtcgaacgacacggccaacctattatgtcgcgacgtacagttcgaaccttaacgcttacgaacgtttcgacgggggacccagggggaccc

SEQ ID NO: 366504 - DNA, 536 bp, Homo sapiens
  misc_feature: GZ8MTXP02FONAO.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggcctccgaggggaaggggctgggagtggggtctcgagttatagaaacagatggcactacatattatctgactcgtgaacgggccgtcaccctctccagacgacacttccaaacaacatcttgtactcttacacatgcacaatctgagagtcgacgacaccgccaccttattacgttgtcgcgtcgactatcgactaacgctacaacttcgtacggggaccgaggggaccg

SEQ ID NO: 366505 - DNA, 618 bp, Homo sapiens
  misc_feature: GZ8MTXP02HGESQ.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgaccgtcgggccccgccgaggcctccggaggggaaggggcgtgggaggtgggtctcgtagtttatagaaacagagtggacactacattattattctagactccggtgaacgggtccggtcaccctctccagtacgactaccttacccaaacaacattacttgtacttccttaccaacattcgactaactaacttcgtagacgacgtaccgaacggtaccaccggtaccctaaccgtttattacgtttgacggaccgtacgtacgacttacggaaacctaacggtacctactaaacgttccggtaccgggggaccggaacgggaccccgg

SEQ ID NO: 366506 - DNA, 553 bp, Homo sapiens
  misc_feature: GZ8MTXP02I22UU.10.38.D05.1.454.CMB.2.raw
  modified_base (347)..(347): a, c, t, g, unknown or other
  modified_base (445)..(445): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaagaggctggatccagccgtgggggtccctgagactctcctgtgcagcctctgggttcagcatcagtaacgactacatgacctgggccccgccaggctccgagggaggggctggagtgggtctcgagttatgaaacngatggacactacatattattctgactccgtggaacgggtccggttaccaccctctccagagacacttccaacaacattccttagtatcttacactatnccataatctgagacgtcgaaccgacaccggacctacccttattagttgtcgcgtaccgactatcgacctaacgctactaacgtttccgacgggggaccaggggacccg

SEQ ID NO: 366507 - DNA, 569 bp, Homo sapiens
  misc_feature: GZ8MTXP02G05SK.10.38.D05.1.454.CMB.2.raw
  modified_base (352)..(352): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatgacctcgggcccgccaggctccgaggggaaggggctgggagtgggtctcagttattagaaacngagtggacacgtacattattattctgactccggtagaacgggtcccggtacacccctctaccgagacgacctaccttacccaaacaacattaccttagtacttccttacactattcgacactaatctagacgaggtcgaacgacgaccggccaacttattacgtgtcgcgacgactatcgactaacgtctactacgtcgtcgggaccgagggacccg

SEQ ID NO: 366508 - DNA, 606 bp, Homo sapiens
  misc_feature: GZ8MTXP02HGUCH.10.38.D05.1.454.CMB.2.raw
  modified_base (410)..(410): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtggtcagcatcagtaacgactacatcgaccgtcgggccccgccaggcctccgaaggggaaggggctgggaggtgggtctcgagttatagaaacagatggacactacattattattctgactccgtagaacgggtccgttacaccctcnccagacacacttaccaaacaactgtcttgtactcttacacgatcgacaactaatctagaacgacgtaccgaaccgaaccgaccggtacccaaacctttaagtttacgtttcggacgaccggtaccgaactaacgttcgaaacccttaaccgctaacccgtaaagtttccggaccgggggacccaaagggggccccg

SEQ ID NO: 366509 - DNA, 627 bp, Homo sapiens
  misc_feature: GZ8MTXP02H896B.10.38.D05.1.454.CMB.2.raw
  modified_base (472)..(472): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctcgtgggtcagcatcagtaacgactacatcgaccgtcgggccccgccgacggcctaccggaaggggaaggggcgtaggggaggtggggtctacgagttaagttagaaaacagagtggactactaacattaatttatctagactccggtaggaacgggtcccgtaccacccctctacccgaagtacgaacctaccttacccaaaactaaacctnttaccgttagtattccttacaactatcgaacaactaattcgagaacgtacgacggaaccgaccaccggaccctaaacttattacttggacgaccggaccactactacgaacctaaccgctaactaacgttccggacgggggccaaacggggcccg

SEQ ID NO: 366510 - DNA, 574 bp, Homo sapiens
  misc_feature: GZ8MTXP02HMO9P.10.38.D05.1.454.CMB.2.raw
  modified_base (404)..(404): a, c, t, g, unknown or other
  modified_base (425)..(425): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtcccctgagactctcctgtgcagcctctgggttcagcatcagtaacgactacatgacctgggccccgccaggcctccgaggggaaggggctgggagtggggtctcgtagttattgaaacagatggcactacatattattctgactccgtgaagggtccgtcacccctntccagacacacttacccaaanaaccagtcttagtactcttacacatcgacacaatctgagtacgtcgacgacaccggacccaaccttagttacttgtcgacgcgaacagttcggaaccttaacgccttacctaaaagtttccggtacgggggaccccaagggggaccccg

SEQ ID NO: 366511 - DNA, 528 bp, Homo sapiens
  misc_feature: GZ8MTXP02G0RR7.10.38.D05.1.454.CMB.2.raw
  modified_base (350)..(350): a, c, t, g, unknown or other
  modified_base (368)..(368): a, c, t, g, unknown or other
  modified_base (394)..(394): a, c, t, g, unknown or other
  modified_base (401)..(401): a, c, t, g, unknown or other
  modified_base (435)..(435): a, c, t, g, unknown or other
  modified_base (484)..(484): a, c, t, g, unknown or other
  modified_base (498)..(498): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccagccgtgggggtccctgagactctcctgtgcagcctcgtgggttcagcatcagtaacgactacatcgacctgggccccgcaggcctccgaggggaggggctgggagtgggtctctaggttatgaaacngatgcatacatattactntgactccgtagaggtcgtccaccctntccaganacacttaccaaacacagtcttagtactcttacanatcacaactaatctgagctacgaacacaccggaccactatttatgcgcnccgaacactcgacncgtcctacgtacgtcggcgggaccgaggcc

SEQ ID NO: 366512 - DNA, 629 bp, Homo sapiens
  misc_feature: GZ8MTXP02JEBOV.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtcctgagactctctgtgcagcctcgtgggtcagcatcagtaacgactacatcgaccgtcgggccccgccgacggcctccggaagggggaacggggcgtgggaggtcggggtctacgtaagtttataggaaacaggacgtcggacaactactattatttattccgtacgtaccgttccggtaggaaccggggtcccgttaccaccctctaccgagacgacctaccttacccaaacaactattctttagtacttcttacactactcgacaactagtctagacgacgtcgaacgaccgaccgtacctaacttagtttagtcggtacgccgtacgactacgtccgaacctaacgtaccttacgtacgtttccggacggggaccgtacggggaccccg

SEQ ID NO: 366513 - DNA, 621 bp, Homo sapiens
  misc_feature: GZ8MTXP02GLSKX.10.38.D05.1.454.CMB.2.raw
  modified_base (348)..(348): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgcaggctccgaggggaaggggctggagtgggtctcagttatgaaacngatggcactacatattatctgactccgtagacgggccgttcaccctctccaagacgacctaacttcccaaaacaactattcctttagtaacttccttacaactattcgacctaaacaaacttcctaagaaggtacgtaccgaacggaccaaccgggtacccctaaacccgtttaatttaagttcggttacggaccgtacgaacctaagtccggtaacctaaccggtccttacgtaaaactttccggacgggggaccccaaggggggtaacccc

SEQ ID NO: 366514 - DNA, 561 bp, Homo sapiens
  misc_feature: GZ8MTXP02HVB7Y.10.38.D05.1.454.CMB.2.raw
  modified_base (451)..(451): a, c, t, g, unknown or other
  modified_base (544)..(544): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctgggccccgccaggctccgaggggaaggggctgggagtgggtctcagttatagaaacagatggacactacatattattctgactccgtagaacgggtccgtccaccctctacccaagacgacaccttcccaaaacaaccattccttagtactccttanactatgacaacaatcctagagatacgacgaacaccggccaaccttattacgtttgacgcgtacgaacattagacctaacgctacaagttccgnggggacccaaggggccc

SEQ ID NO: 366515 - DNA, 524 bp, Homo sapiens
  misc_feature: GZ8MTXP02I2HBC.10.38.D05.1.454.CMB.2.raw
  modified_base (350)..(350): a, c, t, g, unknown or other
  modified_base (416)..(416): a, c, t, g, unknown or other
  modified_base (451)..(451): a, c, t, g, unknown or other
  modified_base (473)..(473): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctcgggcccgccaggctccgaggggaaggggctgggagtgggtctcagttatgaaacngatggcactacatattatctgactcgtgaacgggcgttcaccctctccagacgacacttaccaaanaccattcttgtatcttcactatgcaacatccaganacgtcgaacgcacgccactatnttgcgcgcacatcgactaacgctacaacgttcgtacggggccaggggaccg

SEQ ID NO: 366516 - DNA, 431 bp, Homo sapiens
  misc_feature: GZ8MTXP02I91WJ.10.38.D05.1.454.CMB.2.raw
  modified_base (237)..(237): a, c, t, g, unknown or other
  modified_base (416)..(416): a, c, t, g, unknown or other
  modified_base (418)..(431): a, c, t, g, unknown or other
tcagcatagtagtgcacgaccggtgctcgatttagtatctgatagttgttggaagtgtctctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaattcnggggccagggagcccaggtcaccgtctccccagccctccaccaaggccccatccggtcttccccctggccgcccctgcctccagggacgcctaccctccgagagccaccacgcgtccctggggctgcctggtcaaggcctacgttcccatactatgctgacgcgggctggcaggctcanannnnnnnnnnnnnn

SEQ ID NO: 366517 - DNA, 606 bp, Homo sapiens
  misc_feature: GZ8MTXP02FPLDT.10.38.D05.1.454.CMB.2.raw
  modified_base (302)..(302): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctcgtgggtcagcatcagtaacgactacatcgacctgggccccnccaggcctccgaggggaaggggctgggagtgggtctcgtagtttatagaaacagatggcaactacattattattctgacctccggtagaacggggtcccgtttaccaccccttctaccaagacgaccaccttacccaaacacacttacttgtaacttccttacacctatcgacctaactaaatctagaagtacgtacgaaccgacaccggaccctaacttatttacgtggtcgaccggacgtaccagtccgtaacctaacgtaccctagtaaacgtttcggacgggggacccagggggaacccg

SEQ ID NO: 366518 - DNA, 629 bp, Homo sapiens
  misc_feature: GZ8MTXP02FXDSN.10.38.D05.1.454.CMB.2.raw
  modified_base (411)..(411): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccagggcctaccggaggggaaggggctgggagtgggtctcgtagttatagaaacagatgacactactatattattctgactcgtaggaacgggtccgtcacccttcncaagacgactaccttacccaaacaacctattccttagtactcttacgaactattcgacaactaaagtcctaagaggtaacgttcccggaaacggacccaaccgggtccccctaaaactttaacgtttagtttcggcggaccgtacgacctaaagttcgaaaccttaaccggaccttactaaacggttttccggacgggggacccaagggggaaccccg

SEQ ID NO: 366519 - DNA, 550 bp, Homo sapiens
  misc_feature: GZ8MTXP02GJ1B4.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctggccccgcaggctccgaggggaagggctggagtgggtctcagttatgaaacagatggcactacatattattctgacttccgagaacgggccgttcaccccgtctcccagacgacacttaccaaacacattcttgtactcttacactatcgacacaatctagagagtcgacgacacggcccacttattacgttgtacgcgtacgactaagtcgtaacgtaacgtctactaacgttcgacgggggacctaaggggacccg

SEQ ID NO: 366520 - DNA, 620 bp, Homo sapiens
  misc_feature: GZ8MTXP02IDMAO.10.38.D05.1.454.CMB.2.raw
  modified_base (304)..(304): a, c, t, g, unknown or other
  modified_base (401)..(401): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcacgcctcgtgggttcagcatcagtaacgactacatgacctcgggccccncgacggctccgaggggaaggggctgggagtgggtctcgagttatagaaacagatcggcactacattattattctgactcgtagaacgggtccgttcnccctctccagacacacttccgaaacactattccttagttatcctttacactagtcgtacaacctaaattccgtagaacgtagttacccggaacgaaccacccgggtacccttaacccttaaagttttcgttcggtcgtacccgggacgtaaccagttacgaaccttaacccggtcttaaccgtaactttccgggcgggggacctaacgggggaaccccg

SEQ ID NO: 366521 - DNA, 844 bp, Homo sapiens
  misc_feature: GZ8MTXP02HKTY3.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcggggccccgccgacgggcctacccggaagggggaacgggggccgtaggggacgggttcggggttcctaccgtaaggtttaacgtttaggaaaaaccgaggtagttacggggacctaaccgttaactaatttaacttttaactttcccgttaggtaacccgttaccccggggtacggggtaaaacccggggggttcccccggtttaccccgtaacccccgtttcccgttaccccgaaaggtaacccgtaaaccccgttaaccctttaaacccccaaaaacttaaacccgtacttttacccggttttaacgtacctttacccctttaccaaacccttagtacccggtacctaaaactaaacgttccgtaaggaacggtaccggtacccggaaaccgacccgaacccgggtacccctaaacccgtttaatttacggttcggtaccgcccggaccgtaaacctacgttacccggtaaaccgtaacccggtccttaaccgttaaacggtttcccggggtacgggggacccccggttaagggggtaacccccgg

SEQ ID NO: 366522 - DNA, 652 bp, Homo sapiens
  misc_feature: GZ8MTXP02JT203.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcaagtaacgactacatcgacctgggccccgccaggcctccgaggggaaggggctgggagtgggtctcgagttatgaaacagatggacactacatattattcgtagtacgtccggtagaaccggggtcccggtttaccacccccgttctacccgaaggaacgacctaaccttacccaaaactaaacctacttcctttagtacttcttaccactatcgacctaacaatccgtagagacgtaccgaacgtacccgaaccggtaccctaaccgttaatttaacgttcggtcggacccgtacgtaaaccagttacgaaacccgttaaccggaccttacgtaaaacgttttccggaaccgggggacccgaagggggaacccccgg

SEQ ID NO: 366523 - DNA, 526 bp, Homo sapiens
  misc_feature: GZ8MTXP02FYQQR.10.38.D05.1.454.CMB.2.raw
  modified_base (441)..(441): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtccctgagactctcctgtgcagcctctgggttcagcatcagtaacgactacatgacctgggccccgccaggctccgaggggaaggggctggagtgggtctcagttatgaaacagactggcactacatattatctgactccggtagaacgggccggttcaccctctccagagacacttccaaacaacatcttgatcttacacagtnacacaagtctagagagtcgacgacacggccactattatcgtgcgcgacatgactaacgctacaattcgaggggcccaggggaccg

SEQ ID NO: 366524 - DNA, 618 bp, Homo sapiens
  misc_feature: GZ8MTXP02JXPRM.10.38.D05.1.454.CMB.2.raw
  modified_base (255)..(255): a, c, t, g, unknown or other
  modified_base (468)..(468): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtgggggtccctgagactctctgtgcngcctgtggtcagcatcaagtaacgactacatcgaccgtcgggccccgccgaggcctaccggaggggaaggggcgtgggaggtgggtctcgtagttatagaaacgtagacgtggacaactaactattattattcctacgtaccttccggtagggaacggggtcccggttaccaccccctctacccgaagacgacctaccttacccaaactactnttcctttagtacttccttacactatcgacaacgtattcgaggaacgtacggtcgaaccgacgtaacccggcctaaaccgtttattagttggcgaccgtacgactagtcgaactaacgcttacaacgttcggacgggggacccagggaccc

SEQ ID NO: 366525 - DNA, 640 bp, Homo sapiens
  misc_feature: GZ8MTXP02FNS1H.10.38.D05.1.454.CMB.2.raw
  modified_base (331)..(331): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctcgtgggttcagcatcagtaacgactacatgacctggccccgcaggctccgagggaggggctggagtgggtcncgtagttatagaaacagagtggccaactactattattattctcgtaccgtccgtaggtaaccgggggtcccggtttaccacccccttcgtaccaacggacgacctaacccttaccccaaaacaacctattccgtttacgtaacttcctttacacctaattcgacctaacctaaatccttggaaacgtcgttaccggaaccgtaaccgacggtacccctaacctttaacgtttacttggtacgcccggtacgaccaagtcgaaccttaacgcttacaaacgtttccggacggggaccgtacggggaaccg

SEQ ID NO: 366526 - DNA, 551 bp, Homo sapiens
  misc_feature: GZ8MTXP02FU26T.10.38.D05.1.454.CMB.2.raw
  modified_base (333)..(333): a, c, t, g, unknown or other
  modified_base (366)..(366): a, c, t, g, unknown or other
  modified_base (457)..(457): a, c, t, g, unknown or other
tcagcatagtagtgcacgaccggtgctcgatttagtatctgatagttgggtttggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcatctttagtaatctggcatgtcctgggtcccgccgaggttccaggccacgggctggaagtggggnggcagatatacaatatgatgaacaagtaaaatntactatggagtactcgttacaagggccgattccaccatctacagagactaacttaccaaagaacataggtgtaatctgacaaatcgaccanccgtagagacgccgaggaacgtacggggttattttagttactggttacgggaataaacgtcgtaagtggactagtctaccgtggttactttagg

SEQ ID NO: 366527 - DNA, 654 bp, Homo sapiens
  misc_feature: GZ8MTXP02I9Y3O.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaggtgtccactgtgaggttcaactggtggagacgtggaggagctggatccagccgtgggggtcctgagactctccgtgtcgcagtcctcgtgggtcagcatcagtaacgactacatcgaccgtcggcccgccgacggcctaccggaggggaacggggtcgtgggaggtcgggtcgtacgtagttaagtagaaacagtacgtcggacctaactaacgtattaatttacttccgtagtaccgttaccggtagggtaaccggggtcccggtttaccaccccgtaccgtaccgaacgtaacgaaccctaaccttaaccaaactaactacttacgttatactacttaccactagttacgactaaacctaagtcgtagacggtacgtaccgaacgaccgaccgacctaacttagttagtcggtacgacgtacaactacgtaccgaactcgtactactaacggttcggacggggaccgtaacgggcccg

SEQ ID NO: 366528 - DNA, 573 bp, Homo sapiens
  misc_feature: GZ8MTXP02GG49D.10.38.D05.1.454.CMB.2.raw
  modified_base (346)..(346): a, c, t, g, unknown or other
  modified_base (503)..(503): a, c, t, g, unknown or other
tcagcatagtagtgcacgaccggtgctcgatttagtatctgatagttgggtttgggggggagaggagcccatcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctggccccgcaggctccgaggggagggctggagtgggtctcagttatgaaacngactgcactacatattatctgactccggtgaacggggccgtttccaccctctcccgagacgaacctacttacccaaacaacctatcctttagactcttacacatcgacacaatctagagacgtccgaacgacacggcctaacttagttattggtacnccggacctaatacgtacgaactaacccgtcttacgaaacgtttcggacgggggtacccaagggggacccg

SEQ ID NO: 366529 - DNA, 530 bp, Homo sapiens
  misc_feature: GZ8MTXP02JSECV.10.38.D05.1.454.CMB.2.raw
  modified_base (371)..(371): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggcccgccaggcctccgaggggaaggggctgggagtggggtctcagttatagaaacagatggcactacatattatcngactccgtgagggccgttcaccctctccagacgacacttcccaaacaacatcttagtatcttcacatgacacaatctgacgagtcgacgacacggccaaccttatacttgacgccgcgactatgactaacgctacaacttcgcggggaccaggggaccg

SEQ ID NO: 366530 - DNA, 549 bp, Homo sapiens
  misc_feature: GZ8MTXP02JVAPH.10.38.D05.1.454.CMB.2.raw
  modified_base (454)..(454): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggccccgccaggctccgaggggaaggggctgggagtggggtctcgagttattagaaacagatggcactacatattatctgactcgtgaagggtccgttcaccctctccagacgacacttacccaacaacattccttgtatcttcacatcgacacaattcngacgtagtaccgacgacaccggaccacccgttatactttgcgcgcgaaccagtcacctcgcctacaactttccggcgggggacccaggggacccg

SEQ ID NO: 366531 - DNA, 557 bp, Homo sapiens
  misc_feature: GZ8MTXP02HAUH6.10.38.D05.1.454.CMB.2.raw
  modified_base (353)..(353): a, c, t, g, unknown or other
  modified_base (374)..(374): a, c, t, g, unknown or other
  modified_base (382)..(382): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctcgggccccgccaggcctccgaggggaaggggctgggagtggggtctcagttattgaaacngatggcactacatattattcngactccgngaacgggccgttcaccctctccagagacactccaacacatcttgtactcttacactagtcacaactaatcctagagtacgtcgaacgacacccggccaaccgttattattggtcgcgaccgtacagtcgaacctaacgccttaacgacgtttcggcgggggacccgagggacccg

SEQ ID NO: 366532 - DNA, 569 bp, Homo sapiens
  misc_feature: GZ8MTXP02IM1K9.10.38.D05.1.454.CMB.2.raw
  modified_base (348)..(348): a, c, t, g, unknown or other
  modified_base (397)..(397): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtggttcagcatcagtaacgactacatgaccgtgggccccgcaggctccgaggggaagggctgggagtgggtctcagttatgaaacngagtggacactacattattatctgactcgtagacgggtcgtcaccctcncagacgactacttaccaaacacattcttagtatccttacactatcgactaataatcgagaagacggtcgaacgacaccggtccaactttagttacgttggcgtaccgacgactagttcgaacttaaccgacttacgtaacgtttccggacgggggtaccaacggggtacccg

SEQ ID NO: 366533 - DNA, 687 bp, Homo sapiens
  misc_feature: GZ8MTXP02G0Q7G.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggttcagcatcagtaacgactacatcgaccgtcggggccccgccgacggcctcccggaaggggaacggggcgtgggaggttcggggtctacgtagtttaagtaggaaacagagtaggactaactaactattatttattcgtagtaccgtccggtaggaaccggggtcccggttaccaccccttcgtacccgaaaggacaacctaccttacccaaaactaaccgtattcttagtactacctttaccaactacttcgacctaaactaaagttccaaggaacgtacggtaccgaaacccggtaaccgaaccggtacccctaaacctttaacgttagtttcggacgtacccgacgaacctacgttacggtaaccctaaccgtctaacgtaaacgtttccggacgggggaccccagggggtaccccc

SEQ ID NO: 366534 - DNA, 543 bp, Homo sapiens
  misc_feature: GZ8MTXP02JLPL3.10.38.D05.1.454.CMB.2.raw
  modified_base (352)..(352): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactggaggaggctgggatccagccgtgggggtccctgagactctcctgtgcagcctcgtgggttcagcatcagtaacgactacatgacctgggccccgccaggcctccgaggggaaggggctgggagtgggtctcagttatgaaacngatggcactacatattatctgactcgtgagggcgttcaccctctcagcacacttaccaacacagttccttagtatcttacactatcgacataactcgtagagagtacgaccgactacgccacttattacgttgtcgcgcgtcaagtcgactaacggctaccgtaaattccgtacggggccaggggtacccg

SEQ ID NO: 366535 - DNA, 643 bp, Homo sapiens
  misc_feature: GZ8MTXP02H227S.10.38.D05.1.454.CMB.2.raw
  modified_base (308)..(308): a, c, t, g, unknown or other
  modified_base (365)..(365): a, c, t, g, unknown or other
  modified_base (426)..(426): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccagccgtggggggtccctgagactctcctgtgcagcctcgtgggttcagcatcaagtaacgactacatcgaccgtcgggccccnccaggcctaccgaaggggaacggggctggggaggtgggtctacgagttatagaaacngactggcaactacattatttacttctcgtactcccggtagacggggtcccgtcacccgtcnccgaagacactaaccttaccaaactaactattctttagtactctttaccaactattgaccaaactagtcctagaaaggacgtccgaaaccgtacaacccgggacccttaaaccttaagtttcgtttggacggaccgccgtaaaaccagttacggtaaaccttaaccggtaccttaacgttaacggtttccggtccgggggaaccaacgggggccccg

SEQ ID NO: 366536 - DNA, 564 bp, Homo sapiens
  misc_feature: GZ8MTXP02FI0JE.10.38.D05.1.454.CMB.2.raw
  modified_base (349)..(349): a, c, t, g, unknown or other
  modified_base (369)..(369): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctggagtgggtctcagttatgaaacngatggcatacatattattcngactcgtgaagggtccggttcaccctctccagacgaccacttccaaacaacatcttgtactcttacacatgccaactaaatctagagacgtcgacgaccaccggacccaaccttatttattggtacgccgacgaaccgtatcggaacctaaccgcttactaaactttccggacgggggacccgaggggtacccgg

SEQ ID NO: 366537 - DNA, 594 bp, Homo sapiens
  misc_feature: GZ8MTXP02GVLPM.10.38.D05.1.454.CMB.2.raw
  modified_base (304)..(304): a, c, t, g, unknown or other
  modified_base (415)..(415): a, c, t, g, unknown or other
  modified_base (446)..(446): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgacgactctcctgtgcagcctcgtgggttcagcatcagtaacgactacatcgacctcggcccncaggctccgaggggaagggctggagtgggtctacgtagttatagaaacgtgaagtggacactacagttattattctgactccggtagaacggggtcccgttacaccccgtntcccgaagacgacctacttaccaaacaaccnttcctagtactcttacacatcgactaactaatcgtagagacgtccgaaacgaccacgtacccaactttattacgttggacgcgaccgaacagttcgaacctaacggccttacgtaaacgtttcggaccgggggaccaagggggacccc

SEQ ID NO: 366538 - DNA, 714 bp, Homo sapiens
  misc_feature: GZ8MTXP02H28S3.10.38.D05.1.454.CMB.2.raw
  modified_base (318)..(318): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagactggaggaggctggatccagccggtgggggtccctgagactctctgtgcacgcctcgtgggttcagcatcaagtaacgactaacatcgaccgtcgggccccgccaggccnccgaggggaagggcgtgggaggtgggtctacgagttaatagaaacagactggactaactactaatttagttactttcgtacgtacgtccgtaggaaccgggtcccggttacctacccccggttcacccgaaggtacgtaaccctacccgtttaacccaaaactactactttcgtttagtacttaccgttacaacctatcgaaccaaacctaagttccgtaaggaacgtaccggttaaccgaaacccggaacccgtaacccgggtacccccttaaaacgtttagtttaaacgtttccgggacgacccggtaccggtaactaacggttaccgtaaccctaaccggtaccttacgtaaacggtttccgggaccgggggacccgtaacgggggaaccccc

SEQ ID NO: 366539 - DNA, 631 bp, Homo sapiens
  misc_feature: GZ8MTXP02IXDRV.10.38.D05.1.454.CMB.2.raw
  modified_base (304)..(304): a, c, t, g, unknown or other
  modified_base (330)..(330): a, c, t, g, unknown or other
  modified_base (357)..(357): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactgggtggagactgggaggaggctgggatccagccgtggggggtccctgagactctcctgtgcagcctgtgggttcagcatcagtaacgactacatgacctcgggcccnccaggctcgaggggaggggctagggngtgggtctacgtagttattagaaaacngactggcactactattattattcgtgacgttccgtaggaacggggtcccggttacacccttcgccagacgacctaccttacccgaaactaactatttacctttagtacttcctttacaactacttcgtacctaactaaagtttccaaaggaacggtaccggttaccggaaaccggtaacccgtaaccgggtaccctaaacctaagtttacgttggacgtacgacgactagtcgtactaacgccttacgaacgttcgcggggactacggggaccg

SEQ ID NO: 366540 - DNA, 528 bp, Homo sapiens
  misc_feature: GZ8MTXP02JW1P2.10.38.D05.1.454.CMB.2.raw
  modified_base (398)..(398): a, c, t, g, unknown or other
  modified_base (418)..(418): a, c, t, g, unknown or other
  modified_base (431)..(431): a, c, t, g, unknown or other
  modified_base (440)..(440): a, c, t, g, unknown or other
  modified_base (448)..(448): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctcggcccgccaggctccgaggggaaggggctgggaggtggggtctctagttattagaaacagagtggcactacatattattctgactcgtgaggtccgtcaccctcnccagacacacttccaacacnttactgtactctnacgatcganacaattcngaagtgacgacacacggtcaaccttattacgttgcgcggcacagtgaacctcgctacacttcggacgggcaggggacccg

SEQ ID NO: 366541 - DNA, 581 bp, Homo sapiens
  misc_feature: GZ8MTXP02FHOLY.10.38.D05.1.454.CMB.2.raw
  modified_base (220)..(220): a, c, t, g, unknown or other
  modified_base (356)..(356): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccaggggaaggggctggagtgggtctcagttattgaaacngatggcactacatattatctgactccgtgaagggcccggttcaccctctccagagacacttccaacaacatcttgtatcttcacatgcaacaatctgagagtcgacgacaccggccaccctattatgtgcgcgacntgactacgctcaaattcgtgggggccaggggacgccccgaggtccacccgtcctcccccacgcccctcccaacccgaaacggggccccagtccggttcccttccccccgtcggcccgcccctcgcctccgacggacgccaccctccgaagcgacaccgacggccggcccgtgggggcctcggcccgtgggtacaaacggtacctaccgttaccccactactaacg

SEQ ID NO: 366542 - DNA, 584 bp, Homo sapiens
  misc_feature: GZ8MTXP02IU5H4.10.38.D05.1.454.CMB.2.raw
  modified_base (303)..(303): a, c, t, g, unknown or other
  modified_base (350)..(350): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggtttcaactggtggagactggaggaggctggatccagccgtgggggtccctgagactctcctgtgcagcctcgtgggttcagcatcagtaacgactacatcgacctgggccccnccaggcctccgaggggaagggctggagtgggtctcagttatgaaacngatgcactacatattatctgtactccgtagaacggggtcccgttaccacccctctacccgaagacgaacctaccttacccaaacgtaactatcctttataactctttaccaacgtaatcgacaacctaaatccgtaagagacggtcgaacgaaccaccggtacccaacttaattcgttcgcgactcgaacacgttcgaactaacgactcaaattcggcggggaccaggggaccc

SEQ ID NO: 366543 - DNA, 629 bp, Homo sapiens
  misc_feature: GZ8MTXP02JSDEY.10.38.D05.1.454.CMB.2.raw
  modified_base (489)..(489): a, c, t, g, unknown or other
  modified_base (565)..(565): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctggtcagcatcagtaacgactacatcgacctgggccccgccaggcctccgaggggaaggggctagggagtgggtctcgtagtttattagaaaacagacgtggaccaactacattatttacttcgtacgtaacttccggtaggaaacgggggtcccggttaccacccccttcgtcccgaaagacgtaaccacctttacccaaacaactagttccttagtacttccttanaccagttcgacactaatcgtagagacgtacgacgacaccggacctacgttaattagttcgtcggacgcggtaaccngttaccgaacctaacggtaccctacgtaaacgtttccggaacgggggcccaaacgggggtcccg

SEQ ID NO: 366544 - DNA, 618 bp, Homo sapiens
  misc_feature: GZ8MTXP02JMRHU.10.38.D05.1.454.CMB.2.raw
  modified_base (389)..(389): a, c, t, g, unknown or other
  modified_base (426)..(426): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgacgactctcctgtgcagcctcgtgggtcagcatcagtaacgactacatcgaccgtcggccccgccaggcctccgaggggaagggtctgggagtgggtcctgtagttagttacgaaacaggacgtggactacgtactattattattccngaccttcggtagaacggggtcccgttaccacccttcncccaaggacgaacctaacgttcccaaaacaaccattccttagtacttccttacactatcgacaactaatctagagacgtcgaacgctaacggccctaaacgttattacgttgacggacgtaccgaatacgttacggaccctaacggaccttacgtaaacgttccgggtacgggggaccctagggggaccccg

SEQ ID NO: 366545 - DNA, 595 bp, Homo sapiens
  misc_feature: GZ8MTXP02IQQLH.10.38.D05.1.454.CMB.2.raw
  modified_base (376)..(376): a, c, t, g, unknown or other
  modified_base (419)..(419): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtggttcagcatcagtaacgactacatgacctggccccgcaggctccgaggggaaggggcgtggagtgggtctcgtagttattagaaacagatggccactacattaattattcngaccgtccggtgaacggggtccggttaccaccctctccagganaaccacttacccaaacaactattcttagtatccttacacaagtcacaactaatactagaagagtaccggaacgaccgaccggtacccaaccttaactttattcggcgtcggaccgaccgtaatccggaaaccttcgactaccgtaaattcggtacggggcctaacgggggaacccg

SEQ ID NO: 366546 - DNA, 545 bp, Homo sapiens
  misc_feature: GZ8MTXP02JRADR.10.38.D05.1.454.CMB.2.raw
  modified_base (244)..(244): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttatgaaacngatggcactacatattattctgactccgtgaagggccgttcaccctctccagacgacacttccaaacaacatcttgtatcttcacatgcacaatctgagagtcgacgacacggccacctattatgtgcgcgacatcgactacgctacaattcgtgggccagggacgcccgaggtccaccgtcctccccacgccctccaccgaacggcccacgtccggtcctcccccgtggccgccctcgcctccgacggacgcctacccgccgacgacgcaacgacgccggcccgtgggcctcgcgtacgg

SEQ ID NO: 366547 - DNA, 596 bp, Homo sapiens
  misc_feature: GZ8MTXP02H1WT4.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttccttgttgctatttcaaaaggtgtccactgtgaggttcaactggtggagactggaggaggctggatccgagccgtgggggtccctgagactctcctgtgcagcctcgtgggttcagcatcaagtaacgactacatcgacctcgggcccgccgagggcctccggaaggggaacggggcgtggggaggtgggtctacgagttaattagaaacagatggacactacattattatctagactcgtagaacgggtccgtccaccctctccaagacgacctaccttacccaaaacaactacttaccgttagttacttcctacacattcgacaacaatcgtagagtacgacgacgaaccaccggacctaacgttattacgttgacgccggactaacagttacgaccttaacgccttacgaacgtttcggacggggaccagggacccg

SEQ ID NO: 366548 - DNA, 577 bp, Homo sapiens
  misc_feature: GZ8MTXP02JBNN7.10.38.D05.1.454.CMB.2.raw
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggtcagcatcagtaacgactacatgacctggcccgcaggctccgagggagggctgggagtggtctcagttatgaaaccagatggacactacatattatctagacctccggtaggaaacggggtcccgttcaccccttctaccaagacgacacttacccaaactaacagtccttagtaactcctttacaacctatacgccaaataaacttcctaggtaagacgtaccggacgaacccgaccggtaccctaaccttatttaacgtgtcgcgacgacatcggaactacgactacaacgtttcgacgggggacccg

SEQ ID NO: 366549 - DNA, 573 bp, Homo sapiens
  misc_feature: GZ8MTXP02IL63N.10.38.D05.1.454.CMB.2.raw
  modified_base (382)..(382): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgaccgtcgggccccgcgacggcctccgaggggaaggggcgtgggaggtgggtctcgtagttatagaaacagatggcactacatattattcngacctccgtggaacgggtcccgttccaccctctacccagacgacctacttaccaaacaactcttcttagtattccttacatatcgacaactatcgtagagacggtaccgacgaccaccggtaccctaaccgttattaccgtaggtcgacgtacacagtcgactaccgctactacgttccgtaggggacccg

SEQ ID NO: 366550 - DNA, 541 bp, Homo sapiens
  misc_feature: GZ8MTXP02G0TOQ.10.38.D05.1.454.CMB.2.raw
  modified_base (353)..(353): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactatgaggttcaactggtggagactggaggaggctggatccagccgtggggggtccctgagactctcctgtgcagcctctgggttcagcatcagtaacgactacatgacctgggccccgccaggctccgaggggaaggggctgggagtggggtctcgagttattgaaacngatggcactacatattatctgactccggtgaaggggtcccgtcaccctctccagacgacacttccaaacacattcttagtactcttacacatcgacacaatctagagagtacgacgacgacggccaccgttattagtcgtagcgacgtacatcgactaacgctactacttcgcggggccagggacccg

SEQ ID NO: 366551 - DNA, 591 bp, Homo sapiens
  misc_feature: GZ8MTXP02JC5JF.10.38.D05.1.454.CMB.2.raw
  modified_base (354)..(354): a, c, t, g, unknown or other
  modified_base (480)..(480): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtcgggggtcctgagactctcctgtgcagcctcgtgggttcagcatcagtaacgactacatcgacctcgggccccgcaggctccgaggggaagggctgggagtgggtctcgtagttatgaaaacngagtgacactacgattaattattctgaaccttccgggtaggaaccggggtcccgtttaccgaccctcctaccgagacgaacctaccttacccaaaacaactattccttagtacttcttacactatnactaacatctagagagtccgaacgaccgacggtaccaaccgttattagttcgcgacgtacgacacgtcgtactaaccgcttactacggtcggtacgggacgagggtacccg

SEQ ID NO: 366552 - DNA, 672 bp, Homo sapiens
  misc_feature: GZ8MTXP02IJX5K.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtgggggtccctgagactctcctgtgcagcctcgtgggtcagcatacaagtaacgactaacatcgaccgtcgggccccgcgacggccgtaccgaaggggaacggggcgtagggaggtcggggtctacgtagtttagtagaaaacgtagacgtaggacctaactaactattatttacttcgttacgtaaccgttcccgggttaggtaacccgggggttccgttaccctacccccgtacgtacccgaaacggtaacgacccttaccctttaaacccaaaactaacctaatttccgttagttaactccctttaacacctatcgaccaacgtaacttccgaaggagtacgtccgaaaccgtacgaccgtacctaacttattgttacgcgtacgactaccagttcgaaccttcgacttactaacgttcgggcggtaccgaggaccccg

SEQ ID NO: 366553 - DNA, 607 bp, Homo sapiens
  misc_feature: GZ8MTXP02G1BC2.10.38.D05.1.454.CMB.2.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacttttgttgcttataactatgtctctgtaccagcaccaccagcaaacgccccaaatcctttgtttgagtcagtacgcgcctgaggctcctgactcggttctctccgcctacaagtctacggaccaacgccggtccctccgtcgacccgttctcggtcgggtccctccgaggtcctaggaaggtactgggaacgcttagaacttacactcgacagcgactagttacttacgaaccgcccctaaaggtacggggttgttacggggccgggtacggggtaacttaaaggggtcggtacccggttcggtcggggtacacggacccgtacggcctcccgccccgtggtaccaccgttcctccgtccccacccttccc

SEQ ID NO: 366554 - DNA, 573 bp, Homo sapiens
  misc_feature: GZ8MTXP02JOZIH.10.38.D05.1.454.CMB.2.raw
  modified_base (300)..(300): a, c, t, g, unknown or other
  modified_base (372)..(372): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccagccgtggggggtccctgagactctcctgtgcagcctcgtgggttcagcatcagtacgactacatgacctggccccncaggctccgaggggaggggctgggagtgggtctcgagtttatagaaacagatggacaactacatattattcngtactccgagaacgggtcccgtttaccaccctcgtacccagacgactaccttacccaaactacattcttagacttccttacaacgtatcgacaactaagttccagagtacgtccgacgaccgacgccctaacttattagtcgtcgccacgaccaagtcgaaactccgactacgaacgttcggcggggacccaggggacccg

SEQ ID NO: 366555 - DNA, 553 bp, Homo sapiens
  misc_feature: GZ8MTXP02JP3QL.10.38.D05.1.454.CMB.2.raw
  modified_base (360)..(360): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccagggcctccgaggggaaggggctgggaggtgggtctcgtagttattagaaacngatggcactacattattattctgactccgtagaagggtcccgtcaccctctcgagacgacaccttccaaacacattcttagtactcttcactatcgacactaatcgtagagacgtcgaacgaccacggacccacttattacttgactcggacacagtcgactaacgctacacgttcgacggggccagggaccg

SEQ ID NO: 366556 - DNA, 617 bp, Homo sapiens
  misc_feature: GZ8MTXP02FTKYX.10.38.D05.1.454.CMB.2.raw
  modified_base (488)..(488): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcgaccgtcgggccccgccgaggcctaccggaggggacggggctgggaggtgggtctcgtagttatagaaaacagtacgtggaccaacgtacattaatttattcgtagaccgtccggtaggaaccggggtcccgttccaacccctctccaagacgacctaccttacccaaaacactattcgttatattccttacaactntacgactaaactaactctaggagacgtaccgaacgaccgacggaccctaacttattacgttggtcgaccgacgactacgtcgaactaaccgcttaacgtaacttccgggacggggccgaagggaccccg

SEQ ID NO: 366557 - DNA, 593 bp, Homo sapiens
  misc_feature: GZ8MTXP02HOKK1.10.38.D05.1.454.CMB.2.raw
  modified_base (173)..(173): a, c, t, g, unknown or other
  modified_base (357)..(357): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccncaggctccgagggaagggctggagtgggtctcagttattgaaacagatggcactacatattattctgactccgtgaacgggtccgttcacccctctccagacaccacttaccaacaacatcttgtatcttcacatgcacaatctgagagtcgacgacacggaccaccctattatgtgcgcgacntcgactacgctacagttcgcggggccaggacgcccgaggtcccacccgtccctccccacgccctacccaccgaaccgggccccacgttcccggttcccctttcccccgcgggcccgtccccgtcgaccctccgacggacgcccacccgtccgacgacgccacgcggccggcccgttcggggccctcggaccgtcgggtaccaaacgggtaccctacctttccccaactttacgtcg

SEQ ID NO: 366558 - DNA, 671 bp, Homo sapiens
  misc_feature: GZ8MTXP02I7VHJ.10.38.D05.1.454.CMB.2.raw
  modified_base (506)..(506): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgagccgtgggggtccctgagactctcctgtgcagcctcgtggtcagcatcaagtaacgactacatcgaccgtcggccccgccgacggcctaccggaggggaacggggcgtgggaggttgggtctacgtagtttaatagaaaacagaacgtcggacaactactattaacgttacttcgtacgtaaccgttccggtaggaaccggggtcccgttaccaccctctacgaaggtacaaccctaccttaacccaaaactaactactttcttacgtacttaccttanaacctaagttccgaacctaactaaacttccgtaggtaaacggtacgtaccgaaaccgaacccgaccggacccttaaaccgttagttacgttggacgccgaacgtactaagttcgaaacgtaaccgtctaaccgtaagttccgggacggggacccgaagggccccg

SEQ ID NO: 366559 - DNA, 636 bp, Homo sapiens
  misc_feature: GZ8MTXP02H3EYV.10.38.D05.1.454.CMB.2.raw
  modified_base (273)..(273): a, c, t, g, unknown or other
  modified_base (308)..(308): a, c, t, g, unknown or other
  modified_base (584)..(584): a, c, t, g, unknown or other
  modified_base (593)..(593): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagactgggaggaggctggatccgagccggtgggggtccctgagactctctgtgcagcctcgtggtcngcatcagtaacgactacatcgaccgtcgggccccnccgacggcctaccggaggggaagggcgtgggacggttgggtctacgtagttaatagaaacagacgtggactacgtactattattacttctacgtacctaccggtagggaaccgggttcccgggttacctaccccgttcctaccgaggtaacctacctaaccttaccccaaaactaaactctttcttacgttacttaccttcaaactgttcaaccaactaactcgtagaacggtacgtaccgaacgaacgaccgtacccaacgtttatacgttgacncgtacgacnctcgacctaacgctaactacgttcggacgggaccgtaggcccg

SEQ ID NO: 366560 - DNA, 608 bp, Homo sapiens
  misc_feature: GZ8MTXP02JS5LA.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccggtgggggtcctgagctctcctgtgcagcctgtggtcagcatcaagtaacgactacagtcgaccgtcgggccccgccgacggcctaccggaggggaaggggcgtgggaggtcgggtctacgtagtttaataggaaacgagagtggactaactactattaattacttctacgacgttccggtagacggggtcccgttaccaccctctacccgaagacgacctaccttaacccaaacactacttcgttatacttccttacactatcgacaactaactcaggtaacgacggtacgaacgaccgtaccgacctacgttattacgttgcgcgacgtaccatcgaactcgacttacgtacgttcggacggggaccgtacgggacccg

SEQ ID NO: 366561 - DNA, 528 bp, Homo sapiens
  misc_feature: GZ8MTXP02FTG54.10.38.D05.1.454.CMB.2.raw
  modified_base (350)..(350): a, c, t, g, unknown or other
  modified_base (371)..(371): a, c, t, g, unknown or other
  modified_base (378)..(378): a, c, t, g, unknown or other
  modified_base (396)..(396): a, c, t, g, unknown or other
  modified_base (436)..(436): a, c, t, g, unknown or other
  modified_base (442)..(442): a, c, t, g, unknown or other
  modified_base (479)..(479): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgcaggctccgaggggaaggggctggagtgggtctcgagttatgaaaacngatggcactacatattattcngactcgngaagggccgttcaccctntccagacgactacttccaaacacagtcttagtactcttanacagtncacaatactgagagcgacgacacgacacctacttatntgcgcgacatagactaacgactactatacgtcgggacggacggaaccgg

SEQ ID NO: 366562 - DNA, 563 bp, Homo sapiens
  misc_feature: GZ8MTXP02I91EV.10.38.D05.1.454.CMB.2.raw
  modified_base (228)..(228): a, c, t, g, unknown or other
  modified_base (243)..(243): a, c, t, g, unknown or other
  modified_base (248)..(248): a, c, t, g, unknown or other
  modified_base (355)..(355): a, c, t, g, unknown or other
  modified_base (366)..(366): a, c, t, g, unknown or other
  modified_base (388)..(388): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgtactttgtncttanaactatgtctctgtacagcaccaccagcaaacgccccaaactcttgtttgagtcagtaagcgcctgagacgtcctgatcggtctctcgcctcaagtctggaccaacncggcctcccgngacccgtctcgtcggctcccgngtctgagatgagctagtacttactagtgcagcgactatactcgaacgccccaaaggcgggttgttcggcggtaggtaacgtaagggtcgacccgtcgtcgggtaccgacgcccgaagggtcctacccggtcccccgtggtacctacttccgtccggttcccccacccgtttcccc

SEQ ID NO: 366563 - DNA, 599 bp, Homo sapiens
  misc_feature: GZ8MTXP02HS6U3.10.38.D05.1.454.CMB.2.raw
  modified_base (263)..(263): a, c, t, g, unknown or other
  modified_base (351)..(351): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtcccctgagactctcctgtgcagcctntgggttcagcatcagtaacgactacatgacctgggccccgcaggctccgaggggaaggggctggagtgggtctcgagttattgaaacngatgcactacatattattctgactcgtgaaggggcccgttcaccccgtctccaagacgtaccaccttcccaaaacaacctattaccctttgtaacttcctttaccaacctagttacgaccctaacaaattccgtaggaacgtaaggtccggaaaccgaaccaacccgggcccaaccctttattacgttgtcgacgcgacaattcgacttaacgccttacaacttcgtacgggggacctagggggaccc

SEQ ID NO: 366564 - DNA, 550 bp, Homo sapiens
  misc_feature: GZ8MTXP02FP390.10.38.D05.1.454.CMB.2.raw
  modified_base (353)..(353): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccagggcctccgaggggaaggggctgggagtgggtatcgagttatgaaaacngatggcactacatattattctgactccgtgaacgggtccgttcaccctctccagacgacacttccaaacaacattcttgtatcttacacatgcaacaatctagagtagtcgaacgaccaaccggccaaaccttatttactgtcgccgacgactatcgaactaacgctacaaactttcgacgggggcccagggggacc

SEQ ID NO: 366565 - DNA, 638 bp, Homo sapiens
  misc_feature: GZ8MTXP02IKJOL.10.38.D05.1.454.CMB.2.raw
  modified_base (497)..(497): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtccctgagactctcctgtgcagcctcgtggtcagcatcgaagtaacgactacatcgaccgtcgggccccgccgaggccgtaccggaggggaagggcgtagggaggttcggggtctacgtagttatagaaaacagacgtcgacaactactatttacttacttctacgtacgtaccgtagggaaccgggtcccgtacctacccgttctaccgaagacgaaacctaccttaacccaaacaactattcttagtatccttacaactntcgaaccaataatcgtagaacgtacgtacgaacgacgaccgacctaacttattacgtgtacgaccgactaacgacgtacgtaacccgtaacgtcctaacgttaaacgttccgggaccgggggaccgtaacgggaaccccgg

SEQ ID NO: 366566 - DNA, 601 bp, Homo sapiens
  misc_feature: GZ8MTXP02FVPZ6.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgacctcgggccccgcaggctccgaggggaggggctggaagtgggtctcgagtttatagaaactagagtggacactactatattattctgactccggtaggaacggggtccggttccaccctctccgagacgacctaccttacccaaactaacctattcttagtatccttacacctatcgaccactaaactctagaagtcgtacgaccgaccacggtaccaacttattacgttgtacgcgaccgataactcggtaaacctaacggtaccttaacgtaaaccgtttccggacgggggacccagggggaaccccg

SEQ ID NO: 366567 - DNA, 608 bp, Homo sapiens
  misc_feature: GZ8MTXP02JSVKO.10.38.D05.1.454.CMB.2.raw
  modified_base (352)..(352): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtgggggtccctgagactctcctgtgcagcctctgggttcagcatcagtaacgactacatcgacctcgggccccgccaggctaccgaggggaaggggctggagtgggtctcagttatgaaacngatgcactacatattattctgactccgagacggtcccggttcaccctctacccagacgactacttacccaaacaactacgtttctagttaacttcctttacactaacttcgaccaaactaacgttccgtaggaagtacggttacccgaaacggacccgaaccgggaccctaaacccgttattttaacgtggtacggacgacgtacacttcggactaaccggcttacgtaacgttcggacgggggccaagggggccc

SEQ ID NO: 366568 - DNA, 579 bp, Homo sapiens
  misc_feature: GZ8MTXP02HL4YF.10.38.D05.1.454.CMB.2.raw
  modified_base (257)..(257): a, c, t, g, unknown or other
  modified_base (354)..(354): a, c, t, g, unknown or other
  modified_base (357)..(357): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcngcctcgtggtcagcatcaagtacgactacatcgaccgtcggccccgcgaggcctaccgaggggaaggggctgggagtgggtctcagttactgaaacngangacactactattattatctgtactccggtagaacggggtcccgtactacccctcgtaccctaagcgaacctacttacccaaaactaaccgattcttatacttcttacactagtcactacaatctagaagacgtcgaacgaccaccgactaaccgttattattgacgcacgacacgtacgactaaccgctaacgtaacgttcggacggggaccgaggaccccg

SEQ ID NO: 366569 - DNA, 742 bp, Homo sapiens
  misc_feature: GZ8MTXP02F6EXD.10.38.D05.1.454.CMB.2.raw
  modified_base (307)..(307): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgacgactctcctgtgcagtcctcgtgggttcagcatcagtaacgactacatcgacctcgggccccnccgaggcctaccgaggggaagggctgggaggtgggtctacgtagtttagtagaaaacagacgtggacctaactactaattaattattcgtacgtaccgtaccggtaggaaaccgggggtcccggttaccctaccccctaccgtacccgaaaggtacaaaccctaaccttaacccaaaacaacctacttccgtttagtaacttccctttacgaaacctagttaccgaacctaaaactaaaacgtttccgtaaaggaacggtaacgttacccgggaaaacccgtaacccgtaaccgggaccccctaaaccgtttaaatttaccggttgggtaccggacccgaacggtaaaacctaacgttacggtaaacccgtaaccgtacccttaacgttaaaacggtttccgggaccggggggaaccctaacgggggaacccccg

SEQ ID NO: 366570 - DNA, 670 bp, Homo sapiens
  misc_feature: GZ8MTXP02IIYAH.10.38.D05.1.454.CMB.2.raw
  modified_base (582)..(582): a, c, t, g, unknown or other
  modified_base (622)..(622): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactgggtggagacgtggaggaggctggatccagccgtgggggtccctgagactctcctgtgcagcctcgtgggttcagcatcagtaacgactacagtcgaccgtcgggccccgccgacggcctccggaaggggaacggggcgtaggggagttcggggtcttacgtaggtttaattagaaaacgagaacgtcggactaactaactaatttaatttattccgtagtaacccgttaccggtaggggtaaaccgggggttcccccggtttacctacccccgtacttacccgaaggtaacgaaccttaccctttaaccccaaaataaactattaccttagtactcctttaccaactatcgacctataattccagaacgacgtaccgacgaacnccggaccctaacgttatagtttcggacgtccggactaccngttacgaccaacgtctacgtaacgtcggtacggggactaggggacccg

SEQ ID NO: 366571 - DNA, 538 bp, Homo sapiens
  misc_feature: GZ8MTXP02IOK1N.10.38.D05.1.454.CMB.2.raw
  modified_base (217)..(217): a, c, t, g, unknown or other
  modified_base (351)..(351): a, c, t, g, unknown or other
  modified_base (370)..(370): a, c, t, g, unknown or other
  modified_base (441)..(441): a, c, t, g, unknown or other
  modified_base (463)..(463): a, c, t, g, unknown or other
  modified_base (469)..(469): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccagggaagggctggagtgggtctcagttattgaaacngatggcactacatattattctgactccgtgaacgggccgttcaccctctccagagacacttccaacaacatcttgtatcttcacatgcacaatctgagagtcgacgacacggccaccctattatgtgcgcgacntgactacgctcaatttcgnggggccagggacgcccgaggtccacccgtctccccagccctccaccacgggcccagtccgtccttccccgngccgcccctgccctccgaggcnccaccnccgagacgcacacgccggcccgtcgggcctcgccgtaaggtcaacggtacctacttcccacttactacg

SEQ ID NO: 366572 - DNA, 655 bp, Homo sapiens
  misc_feature: GZ8MTXP02JY7MP.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctgggccccgccgaggcctccggaggggaaggggctgggagtgggtctcagttatagaaacagatggacactacattatttacttctagacgttccggtaggaacggggtcccggtttaccacccccgttctacccgaaggtaacgaaccctacccgtttaacccaaactaaaccatttccttagttacttcctttacactatcgacaacaattcctagaagtacggtaccgacgaaccgaccggaccctaaaccttagtttaacgtttggacggaccggtaccggaaactacttaccgaaccgttaaccgccttaacctaaacggtttccggaccgggggtcccgaagggggtaccccgg

SEQ ID NO: 366573 - DNA, 619 bp, Homo sapiens
  misc_feature: GZ8MTXP02FFGVU.10.38.D05.1.454.CMB.2.raw
  modified_base (353)..(353): a, c, t, g, unknown or other
  modified_base (376)..(376): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctgggccccgccaggctaccgaggggaaggggctgggagtgggtctcgagttatgaaacngatcggacactacatattattcngactcgtagacgggtccggttccacccgttcacccgagaacgtaccaccttacccaaactaacattcctttagtaacttccttacacgtacttcgacaactaaattccgaggagtacgtacggaaccgaccgaaccgggtccctaaaccgttatttacgttggtacgaccgacgaacctagtcggtaaacctccgtacttacgtaaacgtttccggacggggggaccccagggggaacccccg

SEQ ID NO: 366574 - DNA, 662 bp, Homo sapiens
  misc_feature: GZ8MTXP02IZ2IQ.10.38.D05.1.454.CMB.2.raw
  modified_base (328)..(328): a, c, t, g, unknown or other
  modified_base (355)..(355): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtcctgagactctcctgtgcagcctcgtgggtcagcatcagtaacgactacatcgaccgtcgggccccgccaggcctccggaggggaagggcngggagtgggtctctagttatagaaacngatggcaacgtactattattacttctgtactccggtagaaccggggtccgttaccaccctctacccgagacgaacctaccttacccaaaataactattcctttagtactcttacatatacgcaactataccgtgaagtacgtacgaacgacccgacggtacccctaacgtttaatttacggtttacgggcgtacccgggaacctaaagaaacgtttaccgggaaaacccttaacccggtacccttaaagtttaaacccgggtttccggggttaccggggggaaccccgttaacggggggaacccccg

SEQ ID NO: 366575 - DNA, 636 bp, Homo sapiens
  misc_feature: GZ8MTXP02FRHDY.10.38.D05.1.454.CMB.2.raw
  modified_base (269)..(269): a, c, t, g, unknown or other
  modified_base (285)..(285): a, c, t, g, unknown or other
  modified_base (307)..(307): a, c, t, g, unknown or other
  modified_base (311)..(311): a, c, t, g, unknown or other
  modified_base (362)..(362): a, c, t, g, unknown or other
  modified_base (414)..(414): a, c, t, g, unknown or other
  modified_base (437)..(437): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcagttattgaaacagatggcactacattattatctgactcgtgagggtccgttcaccctcnccagacacactccaanaacattcttgtatctcactatnacanaatctagagagtcgacgacaccggcctaccctattagtgtcgcgacgaacngtacgaacttacgcctataaacgtttccgggtcgggggacccaggggtaccncccgaaggtcccacccgttcccnccccgagcccctaccgaacccgtaacgggcccctacgttcccgggttcccctttcccccgcgggcccgtaccccgtgccctaccggacgggaacccgccctacccgccggacgacgaccacggccggcccggtccggtcggacctccggtacccgtaaggaccgtaaacgtacccttaccgtaccctacgttacgtacg

SEQ ID NO: 366576 - DNA, 637 bp, Homo sapiens
  misc_feature: GZ8MTXP02H9T7G.10.38.D05.1.454.CMB.2.raw
  modified_base (494)..(494): a, c, t, g, unknown or other
  modified_base (500)..(500): a, c, t, g, unknown or other
  modified_base (572)..(572): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactgggaggaggctggatccaggccgtgggggtccctgagactctcctgtgcagcctgtgggttcagcatcaagtaacgactaacagtcgaccgtcgggccccgccgagggcctaccggaagggggaacggggcgtggggaggttggggtctacgtagttaattaggaaaacagacgtggactaactactattaattacttctagtactccggtagaacggggtcccgtacaccctctacaggacacctaccttaccaaacaactattcgttatactctacgactatnacctanaactctaggaacgtacgtacgacgtaccaccggtaccctaaactttagttacgtttggcgaccgacgtaacncgttacgaacctaaccggtcttaacgtaacgtttccgggacgggggacccgtaaggggacccccg

SEQ ID NO: 366577 - DNA, 542 bp, Homo sapiens
  misc_feature: GZ8MTXP02I5KJ9.10.38.D05.1.454.CMB.2.raw
  modified_base (406)..(406): a, c, t, g, unknown or other
  modified_base (430)..(430): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtcctgagactctcctgtgcagcctcgtgggttcagcatcagtaacgactacatgaccgtcggccccgccagggcctccgaggggaaggggcgtggaggtggggtctcgtagttattaggaaacaggactggcactacatattatctgactcgtagacgggtcgtcacctcncagacgacactcaaacactatctntactcttacacatcgacacaatctagagacgtcgacgacacggccaacttattactcgtcgccgcgacactcgaactcgctactaacttcgtacggggaccaggggtacccg

SEQ ID NO: 366578 - DNA, 613 bp, Homo sapiens
  misc_feature: GZ8MTXP02FVNHG.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccaggccgtgggggtccctgagactctcctgtgcagcctcgtgggttcagcatcagtaacgactacatcgaccgtgggccccgcagggcctccggaaggggaggggctgggaggtgggtctcgtagttatagaaacagactggacactactattattattcgtagacctcggtaggaacggggtcccgttaccaccccgttctaccgagacgaacctaccttaaccaaacaactattactttgtaacttctttaccacgtatacgactactaaactcgtagagtacgtacgaacgccaccggaccctaacttattacttggtacgccgacgactacgtcgaactaaccgtactacgtaaacgttcggacggggaccgtacgggtaacccg

SEQ ID NO: 366579 - DNA, 582 bp, Homo sapiens
  misc_feature: GZ8MTXP02FT7MS.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtcgggccccgccagggcctccgaaggggaacggggctgggaggtggggtctcgtagttatagaaacagatggacactactatattattctagactccggtagaacggggtcccgttaccaccccttctaccgagacgaacctaccttacccaaacactattcttagtactcttacacatcgacactaatctagagacgtacgacgacacgcctaactattactgcgcgacgactacgtcgaacctaacgcttacgtaacgttccggtacgggggaccaggggacccg

SEQ ID NO: 366580 - DNA, 616 bp, Homo sapiens
  misc_feature: GZ8MTXP02GRIRV.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatacagtaacgactacatcgaccgtcgggccccgccgacggtcctaccggaggggaaggggcgtgggaggtggggtctcgtagtttaagttagaaacgtagacgtggactactactattagttattctacgactccggtagaacgggtcccgtcaccctctaccgagacgaccacttaccaaactactattcttagtactacttacatactcgaccaactaattccgagacgtacgtacgaaccgtacacggaccctaaccttaattacgtggtcgcgactaacgtactacgtactaaccgtctaacgtaacgtttccggacgggggaccctagggggaccccg

SEQ ID NO: 366581 - DNA, 583 bp, Homo sapiens
  misc_feature: GZ8MTXP02IQ8HA.10.38.D05.1.454.CMB.2.raw
  modified_base (351)..(351): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctctgggttcagcatcagtaacgactacatgaccgtcgggccccgcaggcctccgaggggaagggctggagtgggtctcgagttatagaaacngatggcactacattattattctgtactccgtgaacggggtccgttccaccctctaccagacgaacacttacccaaactactattccttagtactcttacgactatcgactaacaatccgagacgacgtccgaaacgaccgaccggacctaaccgtttatagttggtcgacgaccgactacgtaccgacttaacgcttaacgtacttcgggtacggggcccgaaagggtcccg

SEQ ID NO: 366582 - DNA, 611 bp, Homo sapiens
  misc_feature: GZ8MTXP02HTWSK.10.38.D05.1.454.CMB.2.raw
  modified_base (382)..(382): a, c, t, g, unknown or other
  modified_base (427)..(427): a, c, t, g, unknown or other
  modified_base (460)..(460): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcaagtacgactacatcgaccgtcggccccgccgacggcctccggaggggaaggggcgtgggaggtgggtctacgagttattagaaacagagtgacatacattattacttntacgtactccggtcgggtaacgggtcccggttacctacccccgtntcccgaaggacacctaccttacccaaacaactnttacttgttactcttcaagtatcgactaacaacgtctggaagtacgaccggaaccgaccaaccggtaccccaacttactttagtttcggacgccggaacacacttacgacttaaccgctactacgttacggccgggggacacggggacccg

SEQ ID NO: 366583 - DNA, 597 bp, Homo sapiens
  misc_feature: GZ8MTXP02FSNIX.10.38.D05.1.454.CMB.2.raw
  modified_base (397)..(397): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtggttcagcatcagtaacgactacatgacctggccccgccaggctccgaggggagggcgtggagtgggtctcgagttatagaaacagatgcactacatattattctgactcggtagacgggtccgttcaccctntcccagtacgactaccttaccaaacactattcttagtactcttacaactattcgacaactaatcctagacgagtaccgacgaaccacggtaccctaaccgttattacgtttggtcgaccgtacggtaacaacgttcgaaacccgtaacgtacccttagtaaaaccggtttcgggacgggggaccccaagggggaaccccg

SEQ ID NO: 366584 - DNA, 545 bp, Homo sapiens
  misc_feature: GZ8MTXP02GQ91V.10.38.D05.1.454.CMB.2.raw
  modified_base (346)..(346): a, c, t, g, unknown or other
  modified_base (435)..(435): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggccccgcaggctccgagggaaggggctggagtgggtctcgagttatgaaacngactggcactacatattattctgactccgtagaacgggccgttcaccctctccagacgacacttaccaaacacatcttgtatctacacntcgacacaatctagagacgtacgacgacaccggacctaaccttattatgtacgcgcgactactcgacctaacgtcctactaacgtttccgacgggggaccaggggacccg

SEQ ID NO: 366585 - DNA, 579 bp, Homo sapiens
  misc_feature: GZ8MTXP02GRZ6N.10.38.D05.1.454.CMB.2.raw
  modified_base (380)..(380): a, c, t, g, unknown or other
  modified_base (408)..(408): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacatcgacctgggccccgccaggcctaccgaggggaaggggctgggagtggggtctacgagttatagaaacagactggcatacatattattcgtnactccgtagaacgggccgttacaccctnccagacgactacctacaaacacatcttagtactcttacactatcgacaacaacttcgagaacgacggtcgaaacgaccaaccgggccctaaaccttatttacgttcgcgacccgacaactacgtacgactaaccgtctacgtaacgttccgggacgggaccgacgggaccg

SEQ ID NO: 366586 - DNA, 558 bp, Homo sapiens
  misc_feature: GZ8MTXP02JR0AP.10.38.D05.1.454.CMB.2.raw
  modified_base (357)..(357): a, c, t, g, unknown or other
  modified_base (377)..(377): a, c, t, g, unknown or other
  modified_base (449)..(449): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagactggaggaggctgggatccagccgtggggggtccctgagactctcctgtgcagcctctgggttcagcatcagtacgactacatcgacctcgggccccgccaggcctcgaggggaaggggcgtgggaggtgggtctcgtagttattgaaacngatgcactacatattattcngactcggtgaacggccggttcacccgtctccagacgactacttaccaacacattcgttatactcttacactntgacacaatcgtgagacgtacgacgaccgacggccaacgttattattgcgcgacgacaacggttcaacgtaacgcttacgtaacgttcgacggggacccgagggacccg

SEQ ID NO: 366587 - DNA, 563 bp, Homo sapiens
  misc_feature: GZ8MTXP02I7X11.10.38.D05.1.454.CMB.2.raw
  modified_base (349)..(349): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctattttcaaaaggtgtccactgtgaggttcaactggtggagactggaggaggctgggatccagccgtggggggtccctgagactctcctgtgcagcctctgggttcagcatcagtaacgactacatgacctggcccgccaggcctcgaggggaagggctggagtgggtctcagttatgaaacngatggacactacattattattctgactcgtgaacggtcggtcaccctctaccagacgacacttacccaaactacattcttagtactcttacactatcgacactaacgtctagagacgtcgaacgacaccggtccaaccttattacttggtcgccgacgactacgtacgacttaaccgcttacaactttcggacgggggcctaagggggaacccg

SEQ ID NO: 366588 - DNA, 648 bp, Homo sapiens
  misc_feature: GZ8MTXP02GXMCJ.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactggaggaggctggatccagccgtgggggtccctgagactctcctgtgcagcctcgtggtcagcatcagtaacgactacatcggacctcggggccccgccagggcctaccgaggggaaggggctgggaggtggggtctcgtagtttagtagaaacagatggactactacattattattctgtactccggtagaaccggggtccggttacctaccccgtctacccgaagacgacctaccttacccaaactaactacttcctttagtaactccttacaacgtatcgacaactaagtcctagacgtacgtaccgaaacgaccgaccggtacctaaccctttaaagttacgtttcggacgtcccgggaactacgtaacgttacgaaaccgttaaccggccttaaaccgtaaacgtttccggtaccgggggacccgtaagggggacccg

SEQ ID NO: 366589 - DNA, 625 bp, Homo sapiens
  misc_feature: GZ8MTXP02HCYY5.10.38.D05.1.454.CMB.2.raw
  modified_base (256)..(256): a, c, t, g, unknown or other
  modified_base (459)..(459): a, c, t, g, unknown or other
  modified_base (489)..(489): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcngcctcgtggtcagcatcaagtaacgactacatcgaccgtcgggccccgccgacgggcctaccggaaggggaacggggcgtggggaggtggggtctcgtagttagtagaaaacaggatcggaccaactactattattacttctcgactccggtagaacgggtcccgtccacccgtcacgagacgacctacttacccaaacactnttaccttgacttccttacactatcgacaanaacgtctaggaacgacgtccgaaaccgaaccgacccgggacctaaccctttagttacgttcggacgccgtacgaactacgtacgaacctaaccgtactacgtaacgttccgggacggggccgtaaacggggccccg

SEQ ID NO: 366590 - DNA, 521 bp, Homo sapiens
  misc_feature: GZ8MTXP02JZE5I.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactggaggaggctggatccagcctggggggtccctgagactctcctgtgcagcctctgggttcagcatcagtaacgactacatgacctgggccccgccagggctccgaggggaaggggctgggagtggggtctcagttatgaaacagatggcactacatattattctgactccgtgaaggggccgttcacccgtctccagacgacacttccaacaacatcttagtatcttcacatgcacaatctgagagtcgacgacacggccacctattatgtcgcgcgacatgactaacgctcaattcgacgggccagggaccg

SEQ ID NO: 366591 - DNA, 530 bp, Homo sapiens
  misc_feature: GZ8MTXP02IQ6HF.10.38.D05.1.454.CMB.2.raw
  modified_base (349)..(349): a, c, t, g, unknown or other
  modified_base (460)..(460): a, c, t, g, unknown or other
  modified_base (463)..(463): a, c, t, g, unknown or other
  modified_base (487)..(487): a, c, t, g, unknown or other
  modified_base (492)..(492): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggtcagcatcagtaacgactacatgacctgggccccgccaggctccgaggggaaggggctggagtgggtctcgagttatgaaacngatggcactacattattattctgactccggtgaacggggtccggttccaccctctcccgagacgacaccttaccaaacaaccaattcttgacttcttacacatgcacatcnganagtcgacacaccgctactattatntcgcncgacatcgactcgctacaacttcgcgggccagggaccg

SEQ ID NO: 366592 - DNA, 622 bp, Homo sapiens
  misc_feature: GZ8MTXP02FXFZS.10.38.D05.1.454.CMB.2.raw
  modified_base (377)..(377): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccaggccgtggggggtccctgagactctcctgtgcacgcctcgtgggttcagcatcaagtaacgactacatcggaccgtcgggccccgccgagggccctccggaagggggaacggggcgtggggaggtgggtcctcgtaagtttatagaaaacngactggcaactacattacttattcgtgaccgttcggtaggaacgggtccgttaccaccctctaccagacgaaccacttaccaaaacactattcttgtactcttacgactatcgactacctaaattcagagtacgtaccggaacacccgaacggtaccctaacttagtttacgttggcgacgtacgaactagttcgaaacttaaccgacttacgaacggttccgtacggggaccgtacgggacccg

SEQ ID NO: 366593 - DNA, 602 bp, Homo sapiens
  misc_feature: GZ8MTXP02FN27M.10.38.D05.1.454.CMB.2.raw
  modified_base (352)..(352): a, c, t, g, unknown or other
  modified_base (399)..(399): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtccctgagactctcctgtgcagcctcgtgggttcagcatcagtaacgactacatgacctgggcccgccaggctccgaggggaagggctgggagtgggtctcgagttagtagaaacngatggacactacatattattctgactcgtgaacggtccgtcaccctntccgagtacgacctacttacccaactaacattccttgtaactcgttacacatcgactactaatcgaggacgtacggtcgaaaccgtcaaccgggtccctaaacgttagttacgttcggcggaccgtacggtactaaacgtcgaaccttaaccggacttaccgtaaaacgtttcgggacgggggtacccaacgggggtaccccg

SEQ ID NO: 366594 - DNA, 558 bp, Homo sapiens
  misc_feature: GZ8MTXP02JHNX2.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctcgggccccgcaggcctccgaggggaacggggctgggaggtcgggtctcgtagttatagaaacagactggacactacattattatctgacgtcgtagaacggggtccgttaccaccctctaccaggacacacttacccaaacaactatcttagtactcttacactatcgacactaatctagagacgtcgacgacacgccacgttattactgtcgcgacgacatcgaactcgcctacaacgttcgacggggacctaggggacccg

SEQ ID NO: 366595 - DNA, 542 bp, Homo sapiens
  misc_feature: GZ8MTXP02I5IEJ.10.38.D05.1.454.CMB.2.raw
  modified_base (351)..(351): a, c, t, g, unknown or other
  modified_base (396)..(396): a, c, t, g, unknown or other
  modified_base (401)..(401): a, c, t, g, unknown or other
  modified_base (415)..(415): a, c, t, g, unknown or other
  modified_base (418)..(418): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgcaggctccgaggggaaggggctgggagtggggtctcgagttatgaaacngatggcactacatattatctgactcgtgaagggccgttcaccctncaaanagacacttccaaanacntcttnactctcacngtnacacagtcagagagtcgaacgacaccggccctaacttattagtgtacgcggtacactaagtcgaacctaacgctactaaagttccgacgggggacccaggggacccg

SEQ ID NO: 366596 - DNA, 657 bp, Homo sapiens
  misc_feature: GZ8MTXP02HVICD.10.38.D05.1.454.CMB.2.raw
  modified_base (386)..(386): a, c, t, g, unknown or other
  modified_base (490)..(490): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtcctgagactctcctgtgcagcctcgtgggtcagcatcagtaacgactacatcgaccgtcgggaccccgccgacgggccgtacccggaagggggaacggggcgtggggaggtgggtctacgtaagttattagaaacagagtcggacactanattattacttctagtacgtccgtaggaacggggtccgttccacccgttcaccgagacgactactaccaacaactattcttagtactcttacactatcgactaanaattcgtaggaacgacggtaccgaaccggaccgtaacccggccctaaaaccgtttagtttacgtttcggaacggcccgtacggtaaaccctaattccggaaacccttaacggtcccttaaacgttaacgtttccggggacccgggggaaccgtaaacgggggccccg

SEQ ID NO: 366597 - DNA, 606 bp, Homo sapiens
  misc_feature: GZ8MTXP02FUH0B.10.38.D05.1.454.CMB.2.raw
  modified_base (306)..(306): a, c, t, g, unknown or other
  modified_base (356)..(356): a, c, t, g, unknown or other
  modified_base (382)..(382): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatcgaccgtcgggccccnccagacctccgaggggaggggctggagtgggtctcgtagttatagaaacngactgacactactattagttattcgngtacgtccggtagaaccgggtcccgtttaccaccccttctaccgaagacgaactaacttacccaaacaacctatcctttagtactcttacactatcgactaacaattcgagagacgtacgaccgaccgacggtcctaacgttattcgttgcgtaccgacgtactacgtcgtaaacctccgtccgttactaacggttccggtacgggggaccctaaggggtcccg

SEQ ID NO: 366598 - DNA, 631 bp, Homo sapiens
  misc_feature: GZ8MTXP02HE8KM.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccgagccgtgggggtccctgacgactctcctgtgcagcctcgtggttcagcatcagtaacactacatcgacctcgggccccgccaggcctaccggaggggaaggggctagggaggtcggggtctcgagtttagttagaaacgagactggacaactacattattattctagtactccggtagaacggggtcccggtttaccaccccctctaccgacggtacgacctaacccttacccaaactaacctactttacttagtacttccttacaactactcgaccaacctaatccgtagagtacgtaccggaacaccgaaccggtccctaacctttaagttacgttgtacgaccgtcgaactagtacgacctaacggtctacgtactttcgggcggggacccaggggtacccg

SEQ ID NO: 366599 - DNA, 528 bp, Homo sapiens
  misc_feature: GZ8MTXP02FL6VE.10.38.D05.1.454.CMB.2.raw
  modified_base (371)..(371): a, c, t, g, unknown or other
  modified_base (447)..(447): a, c, t, g, unknown or other
tcagcatagtagtgcacgaccggtgctcgatttagtatctgatagttggggtttgggggtagaggagcccagcactgggattccgaggtgtttccattcggtgatcagcactgaacacagaggactcaccatggagttttggctgagcgtgggttttcctgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctgggagtgggtctcagttatgaaacagatggcactacatattattcngactcgtgaaggccggtttcaccctctcagagacacttacccaacaacatcttgtactcttacacatgcacaatcngagagtcgacgacacggccacctattatgtcgcgcgaccatcgacctaaccgctacaacttcgtacggggccagggaccgg

SEQ ID NO: 366600 - DNA, 600 bp, Homo sapiens
  misc_feature: GZ8MTXP02GBZDS.10.38.D05.1.454.CMB.2.raw
  modified_base (364)..(364): a, c, t, g, unknown or other
  modified_base (428)..(428): a, c, t, g, unknown or other
  modified_base (515)..(515): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctggagactctcctgtgcagcctcgtggttcagcatcagtaacgactacatgaccgtcgggccccgccgacggcctccgaaggggaacggggcgtagggaggtggggtctcgtagttatagaaacngatggcactacattattattcgtcgacgtccggtaggaaccggggtccgtttaccaccccttcnccgaagacgaacctaccttacccaaacaactacttcctttagtacttcttacactatcgacactaatcgtagacggacgtacgaacncgaaccggcctacgttatagttgcgacgacgactagtacgactaaccgtctacgtaacgtcggtacggggacctacggggacccg

SEQ ID NO: 366601 - DNA, 568 bp, Homo sapiens
  misc_feature: GZ8MTXP02HS8MD.10.38.D05.1.454.CMB.2.raw
  modified_base (260)..(260): a, c, t, g, unknown or other
  modified_base (361)..(361): a, c, t, g, unknown or other
  modified_base (377)..(377): a, c, t, g, unknown or other
  modified_base (418)..(418): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactggaggaggctggatccagccgtgggggtccctgagactctcctgtgcagcctntgggtcagcatcagtaacgactacatcgaccgtgggccccgccagggcctacccgaagggggaacggggctgggaggttgggtctcgtagttatagaaacngatgcactacatattnttctgactcgagacgggtccgtcaccctctaccagacgacncttaccaaacgactattcgtattactcttacgactattcgacaactaatctagagtacgtcgaacgaccacggccaaccttaattattcgacgcgacgaacattacgaactaaccgctaactacgttcgacgggggacccaggggacccg

SEQ ID NO: 366602 - DNA, 560 bp, Homo sapiens
  misc_feature: GZ8MTXP02I30MX.10.38.D05.1.454.CMB.2.raw
  modified_base (298)..(298): a, c, t, g, unknown or other
  modified_base (340)..(340): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctcgtgggttcagcatcataacgactacatgacctggcccncaggctccgagggaggctggagtgggtctcagttatgaaacngatgcactacatattatctgactccgtagaacggggtcccgttacaccctctcccaagacgaacaccttaccaaaactaaccattcctttagatcctttaccaaacgtattcgaccaactaaacttcagaagagtaccgaacgactacggacccaacttattagtggcgacgacacagtacgaactaacgactactacgttccggacgggaccaaggccg

SEQ ID NO: 366603 - DNA, 691 bp, Homo sapiens
  misc_feature: GZ8MTXP02GY7FC.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcggccccgccaggccgtccggaaggggaacgggcgtaggggaggttcggggttctacgtaggtttaattacggaaaaacgagtaagtacgggacctaacttaactaatttaactttacttcgtacgtaaccgttacccgggtacgggtaaccgggggtccccggtttacccaacccccgttctacccgaaggaacaccctaaccttaacccaaaactaccaattcttagttacttaccttacaactagtcactaacatctagacgtacgtacgaaccgtaccgaccgtaccctaaacctttattacgttggtcgaccggtaccaacgtacttaccggaacgtaaccgtacttaacgtaacgtttcgggaaccgggggccgaaggggtacccccgg

SEQ ID NO: 366604 - DNA, 588 bp, Homo sapiens
  misc_feature: GZ8MTXP02JJ308.10.38.D05.1.454.CMB.2.raw
  modified_base (300)..(300): a, c, t, g, unknown or other
  modified_base (342)..(342): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggattttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggccccncaggctcgagggagggctggagtgggtctcagttatgaaacngatggcactacatattattctgactccggtgaaggggtcccgttcaccctctccagcgacacttacccaaacacattcttgtaactctttacaactatcgactaacaattcctagaagacgtacgaaccgacgaccggaccctaaccgttaatttacgttcggtacgccgtacgaacctagttcggaaaccttccggaccttacgtaaacgttccgggtacgggggacccggaaggggtaccccgg

SEQ ID NO: 366605 - DNA, 643 bp, Homo sapiens
  misc_feature: GZ8MTXP02G8Z6A.10.38.D05.1.454.CMB.2.raw
  modified_base (256)..(256): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccaggccgtgggggtccctgagactctctgtgcngcctcgtgggtcagcatcagtaacgactacagtcgaccgtcgggccccgccgacgggctaccggaagggggaacggggcgtgggaggttcggggtctcgtagtttagttagaaaacgtagactcggactaactactattattacttcgtacgtaccgtccggtagggaaccgggtccggttacccacccgttccgtaccgaaggacacctacccttaaccaaactaactacttacttgtacttcttacactatcacaactatacgagacgtaacgcgaacgacgaaccgtacctaacgttattacgttcggacgacggaccaacgtactacgtaaaccgtccgtactacgttaaacgttccgggacggacccggaacgggtaacccg

SEQ ID NO: 366606 - DNA, 681 bp, Homo sapiens
  misc_feature: GZ8MTXP02FT0QN.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccagccgtgggggtccctgagactctcctgtgcagcctcgtgggttcagcatcaagtaacgactacatcgacccgtcgggccccgccaggcctaccggaaggggaacggggcgtgggaggttggggtctacgtagttaagtagaaaacagagtcggaccaactactattaatttattcgtgaccgttccggtaggaacggggtcccgttaccaccccttctaccaagacgaacctaccttaacccaaaacaacctattacctttgtaaacttccttaaccaacctagtaccgactaaacctaaattccgtaaggaacgtacggttaccgaaaccgaaccgtaacccggtaccctaaaacctttagtttacgttggtacggcccgtagaacctaacgtacgaaccttaaccgcctaacgtaacgtttccggacgggggacccgaaggggaaccccgg

SEQ ID NO: 366607 - DNA, 579 bp, Homo sapiens
  misc_feature: GZ8MTXP02F3RP1.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctggccccgcaggctccgaggggagggctggagtgggtctcgtagttatgaaacagatggcactacattattattctgactccggtagaacggggtcccgttcaccctctcctagacgaaccacttaccaaacactaatccttagtatcttacgactatcgacacaatctagacgagtaccgaacgaaccacggaccctaaccttattacgttgtacgccgacgactaagtcgaaactccggtacttacgtaacgtttccggacgggggacccagggggaaccccg

SEQ ID NO: 366608 - DNA, 631 bp, Homo sapiens
  misc_feature: GZ8MTXP02H305E.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccagccgtgggggtcctgagactctctgtgcagcctcgtgggtcagcatcaagtaacgactacatcgaccgtcgggcccgccaggcctccgaaggggaagggcgtgggaggtgggtctcgagttatagaaacagctaggactactactattattattctcgtacttccggtagggaaccgggtcccggttaccaccccgtcctccgaagaccgtaccaaccttaacccaaaactaactatttccttacgtactttcctaccaaacttatacgtacaaacgtaaacttcgaggaacgacgttacccggaacaacccgcggtaaccccaacgtttattaacgtttcgacgcgacgaactagtcaaccgttaacgctactaacggtttcggccggggaccgacgggacccg

SEQ ID NO: 366609 - DNA, 551 bp, Homo sapiens
  misc_feature: GZ8MTXP02I6PEJ.10.38.D05.1.454.CMB.2.raw
  modified_base (300)..(300): a, c, t, g, unknown or other
  modified_base (352)..(352): a, c, t, g, unknown or other
  modified_base (405)..(405): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggcccnccaggctccgaggggaaggggctgggagtggggtctcgagttattagaaacngatggcactacattattattctgactccgtagaacggggtccggttcaccctnaccagacgacacttccaaacacatcttgactcttacacatcgacactaattcagagagtacgaacgactaccggcctaaccttattattgtcgccacgactatcggaactcgctacgaacttcggcggggaccctagggggaaccc

SEQ ID NO: 366610 - DNA, 576 bp, Homo sapiens
  misc_feature: GZ8MTXP02HU8QK.10.38.D05.1.454.CMB.2.raw
  modified_base (384)..(384): a, c, t, g, unknown or other
  modified_base (413)..(413): a, c, t, g, unknown or other
  modified_base (435)..(435): a, c, t, g, unknown or other
  modified_base (463)..(463): a, c, t, g, unknown or other
  modified_base (486)..(486): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtggtcagcatcagtaacgactacatcgaccgtcgggccccgccgacggctaccgaggggaaggggcgtgggagtgggtctcgagttaattagaaacagacgtggacactactattattattcngtactccgtaggaacggtccgtcaccctnccagacactactaccaacactntcttgtatctacacgattcgacactaanctagacgtacgtcgaccgtaacnccggtaccaaccgtttattacgtttgacgtcgacgaactctacggaacctccgctacgtaacgttccgggacgggaccctaaggggcccc

SEQ ID NO: 366611 - DNA, 576 bp, Homo sapiens
  misc_feature: GZ8MTXP02JB6VK.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgaccgtcgggccccgccaggctccgaggggaaggggctgggagtgggtctcagttatagaaacagatggcaactacatattacttctgtactccgtagaacggggtccgttccaccctctccagacgacctacttaccaaacaacattcttagtactcttacgaactatcgacaactaatctaggaacgacgtccgaacgaccgaccggaccctaaccgttatttacgtgtacgcgacgacctagtcgactaacgctacaacgtttcgcggggaccaggggacccg

SEQ ID NO: 366612 - DNA, 571 bp, Homo sapiens
  misc_feature: GZ8MTXP02HZCMV.10.38.D05.1.454.CMB.2.raw
  modified_base (303)..(303): a, c, t, g, unknown or other
  modified_base (358)..(358): a, c, t, g, unknown or other
  modified_base (412)..(412): a, c, t, g, unknown or other
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctgggatccagcctggggggtccctgagactctcctgtgcagcctctgggttcagcatcagtaaccgactacatgacctcgggccccnccagggcctccgaggggaaggggctggggagtggggtctcgagttattagaaacngactggcactacatattattctgactccggtgaacggggcccgtttcaccctcnccaagcgacctaccttccaaacactatcttgtatcttacactatcgcactatctagagacgtcgaacgacgacgccctaaccttattacttgtcgccgacgacagttacgacctaacggtccctataaacgttccggtcggggaccctaagggggcccg

SEQ ID NO: 366613 - DNA, 571 bp, Homo sapiens
  misc_feature: GZ8MTXP02HXEW0.10.38.D05.1.454.CMB.2.raw
  modified_base (481)..(481): a, c, t, g, unknown or other
  modified_base (517)..(517): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggccccgcgacggctccgaggggaaggggctgggagtggggtctctagttattagaaaccagatgggacactactattattattctgacctcgtgaaacgggtcccggttaccaccctcctccagacgacctaacttaccaacaactacttacttagtacttcttacactatgaccacatcngacgagtcgacgacacggccctacttatactttcgngtccgcgtaaccagtaacgtaactcgacctacgaactttcggtacgggggaccg

SEQ ID NO: 366614 - DNA, 594 bp, Homo sapiens
  misc_feature: GZ8MTXP02GRK73.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggttcagcatcagtaacgactacatcgaccgtcgggccccgccagggcctccgaggggaacggggcgtgggaggtgggtctcgtagttattagaaaacagacgtggacactacattattattctcgactccgtagaacgggtccgttccaccctctcagacgacaccttaccaaacaactatcttgtactcttacactatcacactaactcgtacgaagtacgtaccgaaccgaccgacccggacctaaccgttatttacgttgcgtaccggacaccagtcgaaccgtaacgcctacgtaagttccggacggggaccgacggggtaccc

SEQ ID NO: 366615 - DNA, 738 bp, Homo sapiens
  misc_feature: GZ8MTXP02HZ97G.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtggttcagcatcagtaacgactacatcgaccgtcggccccgcgacggcctaccgaaggggaaggggcgtagggacggttcggggtcttacgtaaggtttaagttacggaaaacaggtaagtcggaccctaacttaacctaattaacgttttacttccgtacggtaaccttaccccggggttaggtaaaccgggggtccccggtttacccaacccccgttcctacccgaaaggaccgtaaccctaaccctttaacccaaaaactaacctaactttccttacgttaacttcctttaccgaactaacgttacgaccaaacgtaaactttccgaaggaacgaacggttaccggaaaccgtaacccgtaaccgggacccctaaaacctttaagttacgttttacgggacgtacggacctaacgtaacttacgaaccgtaaccgtctaaacgtacgtttcgcgggggacctaaacggggcccg

SEQ ID NO: 366616 - DNA, 642 bp, Homo sapiens
  misc_feature: GZ8MTXP02HYNL9.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtgggggtccctgagactctcctgtgcagcctcgtggtcagcatacaagtaacgactacatcgaccgtcgggccccgccgaggcctaccggaagggggaacggggcgtaggggacggtgggtcctacgtagttaatagaaaacgagacgtggacactaactattattattctagtacctccggtaggaacgggtcccgtaccaccctcgccaaggacaccctacttacccaaaatacctattcgttaactactccttacaacctaatcgaaccaaactactcgtaggaacgacggtaccgaaccgaccgaccgtaccctaaacgtttattacgttggcgaaccggacctaactaacgttcgaacctaacggccctaagtaacgttccgggacgggggcccaaaggggcccccg

SEQ ID NO: 366617 - DNA, 602 bp, Homo sapiens
  misc_feature: GZ8MTXP02HAPOS.10.38.D05.1.454.CMB.2.raw
  modified_base (305)..(305): a, c, t, g, unknown or other
  modified_base (474)..(474): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggctggatccagccgtgggggtcctgagactctcctgtgcagcctgtggtcagcatcagtaacgactacatcgacccgtcgggccccnccgacggcctaccggaaggggaacggggcgtagggaggtcggggtctacgtagtttatagaaaacagatcggacaactactattaattattctgtacctccgggtagaaccggggtcccgtacacccccgtcgtaccaaggtacacctaccttaaccaaaactaccgtnttcttagtacttcttacgactatcacaactaatcgtagagacgtacgaacgacaccgcctaacttattagttgacgcgtacgacacgttcgaactcgcctagaacttcggcggggacccaggggaccc

SEQ ID NO: 366618 - DNA, 611 bp, Homo sapiens
  misc_feature: GZ8MTXP02G4NKL.10.38.D05.1.454.CMB.2.raw
  modified_base (368)..(368): a, c, t, g, unknown or other
  modified_base (424)..(424): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccagccgtgggggtccctgagactctcctgtgcagcctcgtgggttcagcatcaagtaacgactacatcgaccgtcgggccccgccgaggcctacccgaggggaacggggcgtagggaggtggggtctcgtagttaatagaaacngatggacactacatattattctcgactccgtagaacggggtccggttacacccctntacccaagacgacctacttcccaaaactacattccgttatacttccttacaactatcgaccaactaacgtcctaaggagacgtacggaacgaccgaccggtacctaccgtttaattacttgtcgggaccacggacaactcggaacctaacgctacgaagtttccggacggggaccgaggaaccccgg

SEQ ID NO: 366619 - DNA, 607 bp, Homo sapiens
  misc_feature: GZ8MTXP02GJ9IR.10.38.D05.1.454.CMB.2.raw
  modified_base (272)..(272): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggtcagcancagtaacgactacatcgaccgtggccccgcacggctccgaggggaacggggctgggagtgggtctcgtagttatagaaacagagtggacaactacattaattattctcgactccggtagaacggggtacccgttaccacctccgactagaacaccttaccaaccaacacttacttcgttatcttacctactatagaccactaactacgtagaagacgtacggaaccgaaccaccggacctaacccttaagttacgttagttacggccgacgaacccgtactagtacccaaccgaactactacgttaacgtcggggaccgacggggacgaccccgg

SEQ ID NO: 366620 - DNA, 584 bp, Homo sapiens
  misc_feature: GZ8MTXP02GEUJT.10.38.D05.1.454.CMB.2.raw
  modified_base (244)..(244): a, c, t, g, unknown or other
  modified_base (265)..(265): a, c, t, g, unknown or other
  modified_base (293)..(293): a, c, t, g, unknown or other
  modified_base (387)..(387): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaaggggctggagtgggtctcagttatgaaacngatggcactacatattattcngactccgtgaacgggccgttcaccctcnccagagaccacttccaaacacattcttgtactccttacactatcgacactaatcgtagaagacgtacgacgacaccggcctacttattagttgngccgacgactatcgactacgctactaattcgtcggggccgagggacgcccgacggtccgacccgtccctccccgacgccctcccgaaccgaccggcccacgtccggtccctccccgtcggcccgtcccgtcgcctccgaggacgccaccgtccgacgcgaccaacgacggcccggcccgtggcctcggtccgtacgg

SEQ ID NO: 366621 - DNA, 598 bp, Homo sapiens
  misc_feature: GZ8MTXP02IMDT2.10.38.D05.1.454.CMB.2.raw
  modified_base (464)..(464): a, c, t, g, unknown or other
  modified_base (468)..(468): a, c, t, g, unknown or other
  modified_base (490)..(490): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtgggttttccttgttgctatttcaaaaggtgtccactgtgaggttcaactggtggagactgggaggaggctggatccagccgtgggggtccctgagactctcctgtgcagcctcgtgggtcagcatcaagtaacgactacatcgaccgtcgggccccgccgacggcctaccggaggggaaggggcgtgggacggttgggtctacgtaagtttagttagaaaacgagtacgtcggacctactactattaacttattctagtacctccggtaggaaccggggtccgtacaccctctaccagacacctactaccaaanactnttctgtacttctacactatcanactaatcgtagacgacgtacgacacgaccgacctaacttagttacttggcacgacgactacgtcgaactaacgctaacgtacgttcggacggggccaacgggggaccc

SEQ ID NO: 366622 - DNA, 714 bp, Homo sapiens
  misc_feature: GZ8MTXP02I6H55.10.38.D05.1.454.CMB.2.raw
  modified_base (242)..(242): a, c, t, g, unknown or other
tcagcatagtagtgcacgaccggtgctcgatttagtatctgatagttgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggcccgccaggctccgagggagggctggagtgggtctcagttatgaaacngatggcactacattattattctgactccgtaggaacgggtccgtcaccctctccagacgacctaccttaccaaacaactattcctttagtaacttcctttaccaactacttcgaacctaacaaacttcgtaggaagtacgtaccggaacgaccaccgggaccctaccgtttatttacgttcggtcgaccgtacgaactacgtacgaacctacgcttacgtaaacgtttccggtacgggggacccgaaggggaccgaccccgtaacggtcccaaccccggttcccctacccccgacggtaccccttaccccgaacccgaaaccggggtccccctaacggttccccgggttcccctttcccccggtcggccccgtccccgttcgcccgtcccgaagggcccgacccgaacccgtcccggaaacgccgaccgaaccgacggcccggccccgtggggccctcggcccgttaacggg

SEQ ID NO: 366623 - DNA, 625 bp, Homo sapiens
  misc_feature: GZ8MTXP02HO8O4.10.38.D05.1.454.CMB.2.raw
  modified_base (559)..(559): a, c, t, g, unknown or other
  modified_base (621)..(621): a, c, t, g, unknown or other
tcagcatagtagtgcacgaccggtgctcgatttagtatctgatagttgggtttggggggagaggagcccagcaccgggattccgaggtgtttccattcggtgatcagcactgaacacagaggactcaccatggagttttggctgagcttgggttttccttgttgctatttcaaaggtgtccactgtgaggttcaacgtgggtggagacgtggaggaggctggatccgaggccgtgggggtcctgacgactctcctgtgcagcctgtgggtcagcatcagtaacgactacatcgacccgtcgggccccgccgaggccgtaccggaagggggaacggggcgtgggaggttcgggtctcgagtttagtagaaaacgagagtcggacaactactattacttaacttctcgtacctcggtaggaccggggttcccgttccaccctcctacgagacgacctacctaccaaacaactcttcttagtaacttcttacaaccgtattcgaactataactcgtagagtacgaccgaacgaccgtaccgccctaaattagtttactcggngaccctagaacagtacgacctacgtctaactaacgttccggaggggacccgaggggtacccncccg

SEQ ID NO: 366624 - DNA, 619 bp, Homo sapiens
  misc_feature: GZ8MTXP02FMZV0.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaggtgtccactgtgaggttcaactggtggagactgggaggaggctgggatccagccgtggggggtccctgagactctcctgtgcagcctcgtgggttcagcatcagtaacgactacatcgaccgtggccccgccaggctccgaggggaaggggctgggagtggggtctcgtaggtttataggaaaacgagagtcggacaactactaattaatttaacttccgtagtaaccgttcccggttagggaaaccgggggtcccggtttacctaacccccgttcgtacccaaggaacgaaccctaaccttaccccaaaacaaccgtattccgttagtaacttccttaacactagttcacacctaaagtctagagagtccgacgacacggccaacttatacttgacgcgacgacagtgactaacgctactacgttcgacggggccgaggggaccc

SEQ ID NO: 366625 - DNA, 597 bp, Homo sapiens
  misc_feature: GZ8MTXP02HXPUE.10.38.D05.1.454.CMB.2.raw
  modified_base (411)..(411): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctctgggttcagcatcaagtaacgactacatcgacctcgggccccgccgaggcctccgaggggaaggggctgggagtgggtctcgtagttattagaaacagatggacactacattattattctagtactcgagaacggggtccgtcaccctnacccagacactacttacccaaacactattcgttatacttcttacactatacgacaactaatccgtaggaacgacgtacgaaccgaaccgaccggaccctaacgttattacgtttggcgtacgaccgactactacgacctaacggtcctaactaacggttccggacggggaccgaaggggaccccgg

SEQ ID NO: 366626 - DNA, 654 bp, Homo sapiens
  misc_feature: GZ8MTXP02GXU29.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtcgggggtcctgagactctcctgtgcacgcctcgtggttcagcatcaagtaacgactacatcgacccgtcgggccccgccgacgggccgtaccggaaggggaacggggcgtggggaggtcgggtctacgtagttaattagaaaacagacgtggacctaactaactaattatttacttcgtcgaaccgttccggtacggaacggggtcccgtttaccacccccttctaccgaaggaacgtacctaacccttacccaaaactaactattaccttagtaccttcttaccactatcgacaactaatcgtagaacgacgtccgaaacgacgtacccgacctaacttagttacgttgcgacggctaacagtacgaaaccgtaacgtcctaacgtaaacgttccgggacgggggacccaagggggtacccc

SEQ ID NO: 366627 - DNA, 659 bp, Homo sapiens
  misc_feature: GZ8MTXP02IG7UY.10.38.D05.1.454.CMB.2.raw
  modified_base (504)..(504): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcacgcctcgtgggttcagcatcaagtaacgactacatggaccccgtcggggccccgccgagggcctaccggagggggaaggggcgtagggaggtcgggtcctacgtagttagtaagaaactagagtcggacctactaactattaatttacttcgtacgtacgttccgggtaagggtaaccgggggtccccgttacctaaccccctctaccaaaggacaacctaaccttacccaaaactactacttcgttntaacttccttacaacctagtcacaactatctaggagacgtccgaaacgtaccgaaccggtaccctaacgtttatttacgtggtcgacgacctaacgacgttacaaccgtaacgtacctacgtaaacgtttcggccggggacctaacgggggaccc

SEQ ID NO: 366628 - DNA, 755 bp, Homo sapiens
  misc_feature: GZ8MTXP02IGEO8.10.38.D05.1.454.CMB.2.raw
  modified_base (708)..(708): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagcgtgggttttccttgttgctatttcaaaaggtgtccactgtgaggttcaactggtggagactggaggaggctggatccagccgtgggggtccctgacgtctctcctgtcgcgacgtccgtcggttcggttacacggactacgtactaaacggtaaaccgtaactaacctacgtacggtaaccccgggtccggggacccccggcccggacggtccccgtaaccggggaaaggggggtaacgggggtccggttagggggtaacggggtttcggggttccgttacgttaaggtttaaacgttaaacggtaaaaacccgaggtaagtcgggaacctaacttaacttaatttacgtttactttacgtacgtaccgttaccggttacgggggtaaaccgggttccccggtaccctaccccgtaccttaccgaacgaccgtaaacccttaccgtaaccaaaactaactacttactacgttacttcgtacactatcacaacgtactcgagacggtacgacgacgacgaccgtaccctattacgttacttcggacgtccgaacgttanacgtaacgtacgtaccgtcgtaacttacgtcgggtacgggacccggg

SEQ ID NO: 366629 - DNA, 570 bp, Homo sapiens
  misc_feature: GZ8MTXP02HS6X3.10.38.D05.1.454.CMB.2.raw
  modified_base (173)..(173): a, c, t, g, unknown or other
  modified_base (218)..(218): a, c, t, g, unknown or other
  modified_base (270)..(270): a, c, t, g, unknown or other
  modified_base (298)..(298): a, c, t, g, unknown or other
  modified_base (312)..(312): a, c, t, g, unknown or other
  modified_base (343)..(343): a, c, t, g, unknown or other
  modified_base (347)..(347): a, c, t, g, unknown or other
  modified_base (359)..(359): a, c, t, g, unknown or other
  modified_base (402)..(402): a, c, t, g, unknown or other
  modified_base (484)..(484): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccncaggctccgagggaagggctggagtgggtctcagttattgaaacngatggcactacattattatctgactcgtgaacggtcgtcaccctctccaganacacttccaacacatcttgtatcttcanatgcacatctgagngtcgacgacacggccaccctattattgtgcncgantgactacgctanaatttcgtcggggccaggacgcccgagggtccacccggttccncccctacgccctacccgaccgaacggggccccacgttccgggttcccttcccccgtggcccgcccctgcctaccgagggacncccgacgtccgagacgtcacgacgccggtcccgtgggcctcgccgtaacggtacaaacggtcctaccgttccccaacttacgtacg

SEQ ID NO: 366630 - DNA, 606 bp, Homo sapiens
  misc_feature: GZ8MTXP02HTP4K.10.38.D05.1.454.CMB.2.raw
  modified_base (421)..(421): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtgggggtccctgagctctcctgtgcagcctcgtgggtcagcatcaagtaacgactacatcgaccgtcgggccccgccagggcctaccggaggggaaggggctggggaggtgggtctcgtagttattagaaacagactggcactacattattattctgtactccggtgaaacggggtcccgtttcacccctntacccagacgacctaccttacccaaacaactacttcttagttacttccttcaaccattcgacaactaatccgtagacgtacgtacgacgaccgaccggacctaacccttatttacgtggtcgcgtacgaactacgtacgaccttaacgcctactaacgttcggtacggggcccgaaggggacccg

SEQ ID NO: 366631 - DNA, 582 bp, Homo sapiens
  misc_feature: GZ8MTXP02INHNC.10.38.D05.1.454.CMB.2.raw
  modified_base (361)..(361): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcacgcctcgtgggtcagcatcagtaacgactacatcgaccgtcgggccccgccgagggcctccgaaggggaggggcgtgggaggtgggtctcgtagttatagaaacngatggctactactattattattctgacctccggtagacggggtccgttccaccctcaccagacgactacttacccaaactacattcttagtactcttacacctatcgaccaactactctagagacgtcgaaccgacgaccgacctaacttatttacttcggtcggaccgtacgactagtcgacctaacgctactaacgtcggtacggggacagggggcccg

SEQ ID NO: 366632 - DNA, 671 bp, Homo sapiens
  misc_feature: GZ8MTXP02H3YUK.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgagttcaactggtggagactggaggaggctggatccagccgtgggggtccctgagctctcctgtgcagcctgtggtcagcatcagtaacgactacatcgaccgtcgggccccgccgacggcgtaccgaggggaaggggctgggaggtgggtctcgagttatagaaacagacgtggaccaactactattaattactttcgtacgtacttcccggtagggaaccggggtcccgttaccaccccgttcacccgaaggacaaccctaaccttaccccaaaactaactagttacccttgtacttccttaccgacttaacgtcgaactacctaaagttccaggtaacgacggtttaccggaaacccgaaccgacccgggtacccctaaaacccgtttattttaaaccgttgggttccgaccggtaccgtaacagttcgaaccttaacggcctttaacaacgtttccggacggggccgaaacggggtcccc

SEQ ID NO: 366633 - DNA, 578 bp, Homo sapiens
  misc_feature: GZ8MTXP02JCAPF.10.38.D05.1.454.CMB.2.raw
  modified_base (352)..(352): a, c, t, g, unknown or other
  modified_base (410)..(410): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgacctgggccccgccaggcctccgaggggaaggggctgggagtgggtctcagttatagaaacngactggcactacattattattctgactccgtaggaacggggtccggttaccacccctntcccgaagacgaccaccttacccaaacaacctatcctttagtactctttaccactattacgcaactaatcctaggatacggtcgaacgacaccgcctaaccttatacgttgcgcacgacaattcgaactaaccgctactaacgttccgacgggggcccaaggggcccg

SEQ ID NO: 366634 - DNA, 554 bp, Homo sapiens
  misc_feature: GZ8MTXP02GJEIW.10.38.D05.1.454.CMB.2.raw
  modified_base (348)..(348): a, c, t, g, unknown or other
  modified_base (397)..(397): a, c, t, g, unknown or other
  modified_base (405)..(405): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggccccgcaggctccgaggggaagggctggagtgggtctcgtagttatgaaacngactggcactacatattatctgactccgtagaacgggccgttcaccctntccaaganacacttaccaaacactatcttagtactcttacacatcgacaactaatcctagagacgtcgaacgacgaccggcctaaccttattacgttgcgccgacgacactcgaactaaccgctacgtaaacttcggacggggaccaaggggacccg

SEQ ID NO: 366635 - DNA, 619 bp, Homo sapiens
  misc_feature: GZ8MTXP02JZL7G.10.38.D05.1.454.CMB.2.raw
  modified_base (501)..(501): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcagtaacgactacatcgaccgtcgggccccgccgaggcctccgaggggaaggggtcctgggaggtgggtctacgtagttattagaaaccagatcggactactactattattacttcgtacgacgtccgtaggtaacggggtcccgttaccaccccgttctacccgaaggacgacctaccgttacccaaaacaacttattccttagttaacttccttacaacgtntacgaaccaccgtaaattccgtaggacgacgtccgaacgtaccgacggtccctaacgttattacgttgccgacgacgtactagcggtacacggctacgtaacttcggacggggacccg

SEQ ID NO: 366636 - DNA, 599 bp, Homo sapiens
  misc_feature: GZ8MTXP02JOE0U.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcgaccgtcgggccccgccgaggcctccggaggggaacggggcgtgggaggtggggtctcgtagttattagaaacagacgtggacactactatattattctgactccggtaggaacgggtccggttccacccttcaccgagacgaccacttacccaaacaacattcttgtacttcttacactatcgactactaatcagagacgtacgacgaccgacgccaaccgttattacgttcggtacgccggacgacgtactcgaacctaaccgacttacgtaaacgttccggtacgggggacccgaggggaaccccg

SEQ ID NO: 366637 - DNA, 586 bp, Homo sapiens
  misc_feature: GZ8MTXP02F2P67.10.38.D05.1.454.CMB.2.raw
  modified_base (413)..(413): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctctgggttcagcatcaagtaacgactacatcgacctcgggccccgccgaggcctccgaggggaaggggctgggagtggggtctcgtagttatagaaaacgagagtggacactacattattattctgacctcggtagacgggtccgtcaccctntaccagagaccacttaccaaacactatcctttagtaactcctttacaacattcgactaacctaaagtccgtagaggacgtaccgaaccgacgacgccctaacttattacgtgtacgcgtacactacgtcgaactaacgtctactaacgttcggacggggacctaggggacccg

SEQ ID NO: 366638 - DNA, 576 bp, Homo sapiens
  misc_feature: GZ8MTXP02GQ9EK.10.38.D05.1.454.CMB.2.raw
  modified_base (374)..(374): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctgggccccgccgaggcctaccgaggggaaggggctgggagtggggtctcgagttatgaaaccagatggacactacatnttattctgactcgtaggaacgggtcccggttcaccctctccagacgacctactacccaacaacattcttagtactccttacactatcgacacaatctagagagtccgacgacgaccggtacctacttattacgttcggcgtaccgccgaaactacgtaacggtaacctacggcctactaacgttccggtacgggggaacccg

SEQ ID NO: 366639 - DNA, 599 bp, Homo sapiens
  misc_feature: GZ8MTXP02I1WN1.10.38.D05.1.454.CMB.2.raw
  modified_base (303)..(303): a, c, t, g, unknown or other
  modified_base (455)..(455): a, c, t, g, unknown or other
  modified_base (473)..(473): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggttcagcatcagtaacgactacatgacctggcccncaggctccgagggaagggctggacgtgggtctcgtagttattacgaaaccagagtgactactacatattattctacgtactccgtagaaacgggtccgttaccaacccttcgtaccaaggtacaccctacttccgaaaactacattccgttntaatccttacaacgttancacactagtcagacgacgtaccgacgacaccgtacctacttagttacgtcgtacgaccgtacgtaactacgtaacgtaacccgtaaccgtacttaccgtaacggtttcccgggtacggggaacccg

SEQ ID NO: 366640 - DNA, 610 bp, Homo sapiens
  misc_feature: GZ8MTXP02JP20J.10.38.D05.1.454.CMB.2.raw
  modified_base (442)..(442): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctcgggccccgcgaggcctccgaggggaaggggcgtgggaggtgggtctcgtagttatagaaacagatggcactacattattacttctgactccgtaggaacgggtccggttacaccctctaccaggacacaccttaccaaactaacnttcctgtactcttacactatcgaccaacatccgtagaacgtacgtacgaaccgaccaacccgggtacctaaccgtttattacgttcggtcggacgaccggtaactacgttacgaacctaacgtcctaactaaacggttccggtacgggggacccgaagggggtacccc

SEQ ID NO: 366641 - DNA, 603 bp, Homo sapiens
  misc_feature: GZ8MTXP02IO6ZG.10.38.D05.1.454.CMB.2.raw
  modified_base (351)..(351): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctggagtgggtctcagttattgaaacngatggcacgtacatattatctgactccgtgaacggggccgttcaccctctccagacgacaccttaccaaacaactacttcttgtactctttacactattcgaccactaatccgtgaagtagtccgaacgtaccgaaccgggtcccaaccctttattaacgtttggtacgccggtaacggacctaagttcggaaacctaaccggtccttaccgtaaaactttccggacgggggacccgtaaggggaaccccgg

SEQ ID NO: 366642 - DNA, 602 bp, Homo sapiens
  misc_feature: GZ8MTXP02G5AL0.10.38.D05.1.454.CMB.2.raw
  modified_base (413)..(413): a, c, t, g, unknown or other
  modified_base (547)..(547): a, c, t, g, unknown or other
  modified_base (554)..(554): a, c, t, g, unknown or other
  modified_base (569)..(569): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctgggccccgccaggctccgaggggaaggggctgggaggtgggtctacgagttattagaaacagactggcactacattattattctagactccggtgaacggggtcccgttacacccctntaccaggacgacctacttacccgaaacaactattaccttagttacttccctttacaacctattcgacaacaacttccgtaggaagtacggtcgaaccgaaccgaccggacctaaccgttattacgttgtcggcnccgtaanactcgaactaaccgnttaccgaaacttcggtcgggaccgagggacccg

SEQ ID NO: 366643 - DNA, 525 bp, Homo sapiens
  misc_feature: GZ8MTXP02F2AT1.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggccccgcaggctcgaggggaggggctgggagtgggtctcgagttatgaaacagatggcactacatattatctgactcgtgaacgggtccgtcaccctctccagacacacttaccaaacacatcttgactcttacacatgcaactatctgagacgtcgaacacacggccaacctattactggtcgcgcgacatcgactaacgctacgaacttcgacggggaccaggggacc

SEQ ID NO: 366644 - DNA, 400 bp, Homo sapiens
  misc_feature: GZ8MTXP02GXW3O.10.38.D05.1.454.CMB.2.raw
  modified_base (294)..(294): a, c, t, g, unknown or other
  modified_base (386)..(400): a, c, t, g, unknown or other
tcagcatagtagtgcacgaccggtgctcgatttagtatctgatagttgggtttggggggaagaggaagactgacggtcctgccacaggtggtgctgggccggttcaccctctccagagacacttccaacaacatcttgtatcttcacatgcacaatctgagagtcgacgacacggccacctattattgtgcgcgacatgactacgctcaattctggggccagggagcccaggtcaccgtctccccagccctccaccaaggcccatcggtcttcccctgcgccctgcctccaggngcacctccgagagcacagccggccctgggctgcctggcaggactacttcccccactactatgctggagcggggctgggcacggcgcagtagnnnnnnnnnnnnnnn

SEQ ID NO: 366645 - DNA, 537 bp, Homo sapiens
  misc_feature: GZ8MTXP02JDDVE.10.38.D05.1.454.CMB.2.raw
  modified_base (353)..(353): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctattttcaaaaaggtgtccactgtgaggttcaactggtggagactggaggaggctggatccagcctggggggtccctgagactctcctgtgcagcctctgggttcagcatcagtaacgactacatgacctgggccccgcaggctccgaggggaaggggctgggagtggggtctcgagttatgaaacngatggcactacatattatctgactcgtgacgggtccgttcaccctctccagacgacacttcaaacacatcttgtatcttacacatcacacaatctgagagtcgaacgacacggacctaaccttatacttgtacgcgacgacactcgactaacgcctactaacttcgtacggggccaggggaccg

SEQ ID NO: 366646 - DNA, 551 bp, Homo sapiens
  misc_feature: GZ8MTXP02FKX28.10.38.D05.1.454.CMB.2.raw
  modified_base (303)..(303): a, c, t, g, unknown or other
  modified_base (399)..(399): a, c, t, g, unknown or other
  modified_base (426)..(426): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcagcctctgggttcagcatcagtaaccgactacatgacctggccccncaggctccgaggggagggctgggagtgggtctcgagttatgaaacagatggcactacatattatctgactccgtaggaacgggccgttcacccttnccagtacgacacttacccaaacaactnttccttgtactcttaccactatcgacaacaagttcagagacgtcgaacgacaccggccaacttattacgtgtacgcgtcgacactcgaacctcgctactaacgttcgacggggccagggggaccc

SEQ ID NO: 366647 - DNA, 646 bp, Homo sapiens
  misc_feature: GZ8MTXP02GFK11.10.38.D05.1.454.CMB.2.raw
  modified_base (368)..(368): a, c, t, g, unknown or other
  modified_base (469)..(469): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatcgaccgtcgggccccgccagggcctccggaaggggaacggggcgtggggaggtggggtctcgtaatttatagaaacngatggacactacaattatttatcgtagtaccgtccggtaggtaaccggggtccgttccaccccttctcccgaaagaccgaactaccttacccaaacaactnttcttagtactcttacacagtcacataatctaggacgtacgtaccgaacgtaccgaccggtaccctaacctttaaagtttacgtttacggtccggaccgacggtaaacctataccggtaacctaaccgacttaacgttaaacggtttccggacgggggacccaacgggggtaccccg

SEQ ID NO: 366648 - DNA, 560 bp, Homo sapiens
  misc_feature: GZ8MTXP02JPKN5.10.38.D05.1.454.CMB.2.raw
  modified_base (356)..(356): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccgaggcctccgaggggaaggggctgggagtgggtctcgagttatgaaacngatggacatacatattattctgactccgtagaacgggtccgttccaccctctcagacaccacttcccaaacacattcttgtacttcttacacatgcaactaatctagagagtcgaacgaccgacggccctaacgttattacgttgacgccgtacgaactatcggaacctcgcttaccaagtttcggacggggacccaggggacc

SEQ ID NO: 366649 - DNA, 608 bp, Homo sapiens
  misc_feature: GZ8MTXP02FV4NH.10.38.D05.1.454.CMB.2.raw
  modified_base (308)..(308): a, c, t, g, unknown or other
  modified_base (354)..(354): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctctgtgcagcctcgtgggttcagcatcagtaacgactacatcgacctggccccgcacggcncgaggggaggggcgtgggagtggggtctcgtagttattagaaaacngagtggacactacaattattattctgacttccggtaggaacggggtcccggttaccaccctctaccgaagtacgaacctaccttacccaaacaactattcttagtacctcttacactatacgactaactattcgagtacgagtacccggaacaccgaacgacccctaacgtttattacgttgtcggacgaccgactaaggtctaacctaacgtcttacgtaaacgttccggacggggacccgtaggggaacccg

SEQ ID NO: 366650 - DNA, 602 bp, Homo sapiens
  misc_feature: GZ8MTXP02HKQWI.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggccccgcaggctccgaggggaaggggcgtggagtggggtctctagttattagaaacagatggcactacatattatctgactcgtgaacgggccgtcaccctctcagagaccacttacccaaacaactactcctttagtacttcttacactattcgccaactaaattccgtagaacgacggttacgaaacccgaaccgaccgggaccctaaccgttaattacgttggtcgacccggacgaactacgtacgtaaccgtaaccggccttacgtaaactttcggtacgggggacccctaagggggaccccgg

SEQ ID NO: 366651 - DNA, 562 bp, Homo sapiens
  misc_feature: GZ8MTXP02JA5ZA.10.38.D05.1.454.CMB.2.raw
  modified_base (353)..(353): a, c, t, g, unknown or other
  modified_base (364)..(364): a, c, t, g, unknown or other
  modified_base (402)..(402): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctgggatccagccgtgggggtccctgagactctcctgtgcagcctcgtgggtcagcatcagtaacgactacatcgaccgtgggccccgcgaggctccgaggggaaggggctgggagtgggtctctagttatgaaacngatgacactanatattattctgactccgtgaacgggtccgttcaccctncccagacgacaccttaccaaacactactcttatactcttacactatcgcaactaattcagacgaggtaccgacgaccaccggccctaactattacgttgcggacgcgtaaccagttcgaaactcgccttacgaacgtttcggcggggcctaagggggccc

SEQ ID NO: 366652 - DNA, 550 bp, Homo sapiens
  misc_feature: GZ8MTXP02GK16R.10.38.D05.1.454.CMB.2.raw
  modified_base (289)..(289): a, c, t, g, unknown or other
tcagcatagtagtgcacgaccggtgctcgatttagtatctgatagttgggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagaacgactacancgacctgggccccgccaggctccgaggggaaggggctgggagtggggtctcgagtttatgaaacagatggcactacatattatctgactccgtgaacggggccgtcaccctctcagagacacttaccaaacacctatccttgtactcttccacgtatgacacaaatctgagagtacgacgacacggacccaccttattacttgtcgccgcgacaatcggaactaacgcttacgaaactttcgacggggaccaggggacccg

SEQ ID NO: 366653 - DNA, 549 bp, Homo sapiens
  misc_feature: GZ8MTXP02FGBLA.10.38.D05.1.454.CMB.2.raw
  modified_base (216)..(216): a, c, t, g, unknown or other
  modified_base (237)..(237): a, c, t, g, unknown or other
  modified_base (263)..(263): a, c, t, g, unknown or other
  modified_base (339)..(339): a, c, t, g, unknown or other
  modified_base (346)..(346): a, c, t, g, unknown or other
  modified_base (375)..(375): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccgccaggctccagggaaggggctggagtgggtctcagttattgaaacngatggcactacatattattcngactccgtgaagggccgttcaccctntccagagacacttccaaacaacatcttgtatcttcacatgcacaatctgagagtcgacgacaggccactattatgncgcgacntgactacgctcaattctggggccagggancccaggtcaccgtctcccccagccctccaccaaacgggccccaagtccggtccttcccccgtggcccgcccctgccctccgaggacgccaccctccgagacgccacgacgccggcccgtggggcctcggccctggtaaccgaaacgggaccttacctccccaactacctactcg

SEQ ID NO: 366654 - DNA, 551 bp, Homo sapiens
  misc_feature: GZ8MTXP02F5BWM.10.38.D05.1.454.CMB.2.raw
  modified_base (353)..(353): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctgggccccgcaggctccgaggggaggggctgggagtgggtctcgagtttaatggaaacngatggcactacatattattctgacctcgtagaagggtcccggttaccaccctctccagagacacttaccaaacaacatcttgtactcttacacaatcgacaacaaatctagagacgtacgaacgacaccggcctaacctaattatgtcgcgacgtacatcgaactaacgctactaacttcgcggggaccaggggaccg

SEQ ID NO: 366655 - DNA, 748 bp, Homo sapiens
  misc_feature: GZ8MTXP02JIBLK.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcagtaacgactacatcgaccgtcgggccccgccgagggcctaccggaagggggaacggggcgtaggggaggttcggggtacctacgtaaggtttaagttacggaaaacgtagaacgttcgggacctaaacttaacgtaatttaactttaactttcgtacgtaccgttacccgggttaagggaaccgggggtccccgtttaccaccccgttctacccgaaagtaacgaaccctaccttaacccaaaactaaacctactttacctttagtacttccttaccaactacgtacgacctaaactaaagttccgtaagaacggaaccggttacggaaccgaacccgaaccgggtcccctaaaacgtttaacgtttagtttcggacgtacccgaacggtaaactacgttacggtaaacctaaccggtacttaaccgttaaacggttcccgggtaacgggggaccccgaaggggtaacccccg

SEQ ID NO: 366656 - DNA, 588 bp, Homo sapiens
  misc_feature: GZ8MTXP02FWY5G.10.38.D05.1.454.CMB.2.raw
  modified_base (467)..(467): a, c, t, g, unknown or other
  modified_base (470)..(470): a, c, t, g, unknown or other
  modified_base (473)..(473): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtggttcagcatcagtaacgactacatcgacctgggccccgccaggctccgaggggaggggcgtgggagtgggtctcgtagttatagaaacagatggacactactattattattctagtacctccggtaggaacggggtcccgttaccaccccttctcccaagacgaacctaccttacccaaacaacctatcttagtatccttanacntcncaactaagtctagacgtagtcgaacgaccacggaccaacttatttactggtacgccgtacgaactactgaaccttaacgcttacgaacgtttcgacgggggacccagggggaccc

SEQ ID NO: 366657 - DNA, 576 bp, Homo sapiens
  misc_feature: GZ8MTXP02FZ5SY.10.38.D05.1.454.CMB.2.raw
  modified_base (387)..(387): a, c, t, g, unknown or other
  modified_base (415)..(415): a, c, t, g, unknown or other
  modified_base (421)..(421): a, c, t, g, unknown or other
  modified_base (437)..(437): a, c, t, g, unknown or other
  modified_base (444)..(444): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagacgtgggaggaggctggatccaggccgtgggggtccctgagactctcctgtgcagcctcgtgggttcagcatcaagtaaccgactacatcgaccgtcggccccgcaggctccgaggggaaggggctgggagtgggtctcgtagttatagaaaactgacgtggacactactatattattcgnacctcgtagaacgggtccgtcacccttnccaganacacttaccaaacacntcgttanactcttacactagtcacaactaagtctagagagtccggaacaccgaccgcctaaccttattacgttgcgacgtacaccgtaatcgaaacctaacgtctacgtaacttccggacggggccaaggggaaccccg

SEQ ID NO: 366658 - DNA, 559 bp, Homo sapiens
  misc_feature: GZ8MTXP02IXSSW.10.38.D05.1.454.CMB.2.raw
  modified_base (301)..(301): a, c, t, g, unknown or other
  modified_base (345)..(345): a, c, t, g, unknown or other
  modified_base (366)..(366): a, c, t, g, unknown or other
  modified_base (437)..(437): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactgggaggaggctggatccagccgtggggggtccctgagctctcctgtgcagcctctgggttcagcatcagtaacgactacatgacctgggcccncagctccgaggggaagggctggagtgggtctcagttatgaaacngatgacactacatattattcngactccgtagaacgggtccgttacaccctctaccagacgacactacaacactatctatactcttacactanctaccaataactctagacgacgtcgaacgacgaccgacctaaccttacttagttcgtacgacgactacaggttcaactaaccgtactactaaacgttcggaccgggacgacggggaaccccg

SEQ ID NO: 366659 - DNA, 673 bp, Homo sapiens
  misc_feature: GZ8MTXP02JKG9H.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactggaggaggctggatccgagccgtggggggtccctgagactctcctgtgcagcctcgtgggttcagcatcagtaacgactacatcgaccgtcgggccccgccgaggcctccggaggggaagggctgggagtcgggtctcgtagttatagaaacgagagtggaccactacattattattctgacttccggtagaacggggtcccgttacacccgtctaccgaagacgtaccacctttacccaaaacaacctattaccgttagtacttcctttacaacctagttacgacctaaactaacgtaccttaggaacggacgttaccggaaccgtacccgaacccgggtacccctaaacctttaagtttacgttcggtacggccggtaaccggtacctaacgttcgtaacccgttaaccggccttacgtaaacgtttccggtaccgggggacccggtaacgggggaaccccg

SEQ ID NO: 366660 - DNA, 594 bp, Homo sapiens
  misc_feature: GZ8MTXP02JJ65U.10.38.D05.1.454.CMB.2.raw
  modified_base (363)..(363): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagacgtggaggaggctggatccgaggccgtgggggtccctgagactctcctgtgcagcctcgtgggtcagcatcagtacgactacatcgaccgtcggccccgcacggcctccgaggggaaggggcgtgggagtcggggtctcgtagtttatagaaaacngagtggcaactacattattattctagacgttccggtaggaacgggtcccgttacaccctctccgagacgactacttaccaaacacattcttagtactcttacactatcgacaactaactacgtgaacgagtaccgacgaaccacggtacccaccttaattagtaggtcgcgacggtaccatacggaacctaacgactacgtaacgttccggacggggaccacgggggaccc

SEQ ID NO: 366661 - DNA, 651 bp, Homo sapiens
  misc_feature: GZ8MTXP02JGWQ4.10.38.D05.1.454.CMB.2.raw
  modified_base (262)..(262): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggagctggatccgagccgtgggggtccctgagactctcctgtgcagcctntgggttcagcatcagtaacgactacatcgaccgtcggccccgcgacggcctaccggaaggggaaggggctagggtagtcgggtctcgtaagttagtacgaaaacgagtagtcggactaactaactattatttaattcgtagaccgttaccggtaggaaccggggtcccggtttaccaccccttcgtacccgaagacgaaccctacttacccaaaacaactacttctttagacttccttacgactactgaccaagtaacttcctaggagtacgtaccggaaccaccgacggtaccctaacttagtttacgtcgtacggaccgacgtaaactacggtaccaactaaccggcttaacgtaacgttccgggacgggacccgtagggaaccccg

SEQ ID NO: 366662 - DNA, 720 bp, Homo sapiens
  misc_feature: GZ8MTXP02HZ3R4.10.38.D05.1.454.CMB.2.raw
  modified_base (366)..(366): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccaccgtgaggttcaactggtggagacgtgggaggaggctggatccagccgtgggggtccctgagactctcctgtgcagcctcgtgggttcagcatcaagtaacgactacatcgacctcggcccgccaggcctccgaggggaagggctggagtgggtctgtagttatagaaacagatcgctaactanattattacttctgtaccgttccgtaggggaaccggtcccgggttccaacccttctacccgagtaccgactaccttaccaaaactaactacttcttagtaacttcttaccaaactcgttacaacctaactaaacttcgtaacggaagtaaccgtaccggaaccgaaaccgccggtaacccctaacccgtttaagttttaaacgtttcggttaaaccgggtcccgaaacggtaaaccgttacgttaccgggtaaaccctttaacccggtaacccgtttaaacccgttaaaaccggttttccccggggttaaccgggggaaccccgggttaaaacggggccccggtaaccccccggg

SEQ ID NO: 366663 - DNA, 534 bp, Homo sapiens
  misc_feature: GZ8MTXP02FH8BJ.10.38.D05.1.454.CMB.2.raw
  modified_base (202)..(202): a, c, t, g, unknown or other
  modified_base (349)..(349): a, c, t, g, unknown or other
  modified_base (371)..(371): a, c, t, g, unknown or other
  modified_base (439)..(439): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgagttcaactggtgganactggaggaggctggatccagccgtgggggtccctgagactctcctgtgcagcctctgggttcagcatcagtaacgactacatcgacctgggccccgccaggcctccgaggggaaggggctgggagtgggtctcgagttatgaaacngactggcactacatattagtcngactcgtagaacggtcggttcaccctctccagacgacactacccaacaacatcttgtactctcacatnacacaagtcagagacgtcgacgacaccggtccaacctattacgtgtcgcgcgacatcgacctaacgctacaacgttcgacgggggccagggaccg

SEQ ID NO: 366664 - DNA, 580 bp, Homo sapiens
  misc_feature: GZ8MTXP02HRMJI.10.38.D05.1.454.CMB.2.raw
  modified_base (304)..(304): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtctgggttttccttgttgtctatttcaaaaggtgtccactgtgaggttcaactggtggagacgtggaggaggctggatccgagccgtgggggtccctgagactctcctgtgcagcctctggttcagcatcagtaacgactacatcgacctgggccccnccgagggcctaccggaggggaaggggcgtgggtaggtggggtctcgtagttattagaaactagatggacactactattattattctgtactccgtgaacggggtccgttacaccctctaccgagacgtaccacttaccaaacgtactacttcttagtactctacactatgacacatctagacgtagtcgacacgcgacctacgtattagtgacgcgacgactagtacgacttaacgactactaacggttccgtacggggaccctaaggggtacccg

SEQ ID NO: 366665 - DNA, 665 bp, Homo sapiens
  misc_feature: GZ8MTXP02H2S07.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccgagccgtgggggtccctgagactctcctgtgcagcctgtgggttcagcatcagtaacgactacatcgaccgtcgggccccgccagggcctaccggaggggaacggggctgggaggtgggtctacgagttaatagaaacagactcggacaacgtactattattattctacgtacctccgggtaggaaccgggtcccggtaccaaccccgtctacccgaaggtaccgtaaccctaccttaaacccaaactaaacctctttacctttagtacttccttacaacctagtacgacctaaactatcgtaggaacggtacgtaccggacaacccgaccgtaccctaacgtttagtacgtttcgggacaccggtaccgtacgtacgtccgtaaacgtccgtacttaacgtacggttacgggaccggggaaccggtaacggggaccccg

SEQ ID NO: 366666 - DNA, 722 bp, Homo sapiens
  misc_feature: GZ8MTXP02JSB6T.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccggtgggggtccctgagactctcctgtgcagcctcgtgggttcagcatcagtaacgactacatcgaccgtcgggccccgcgacggcctccggaggggaaggggctgggaggtgggtctcgagttagtagaaacagacgtgacactactattattattcgtacgtacgtccggtaggaacggggtcccgttaccaccccttctacccgagaacgacctaccttacccaaactaactacttccttagtactccctttacactacttacgactaactaaacgttcctaagggaacgaaccggttacccggaaaccggaaccccgtaaacccggggtaccccttaaaacccgttttaagtttaacggtttcgggtacccggaccggaacccgttaacgaacgtttacccggaaacccttaaccggtccccgtttaaaccgttaaacggttttcccggggtaaacccggggggtaccccgtaaacggggggaaccccccgg

SEQ ID NO: 366667 - DNA, 591 bp, Homo sapiens
  misc_feature: GZ8MTXP02H6VQA.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtggtcagcatacagtaacgactacatcgaccgtcgggccccgccgaggcctccgaaggggaaggggctggggagtgggtctcgagttatagaaaacagagtggactactaactattattaattcgtgtacctcccggtagtaacggggtcccgttaccacccctctccaagacgaacaccttaccaaaactactatcttagtactcttacactatcgacaactatcgtagagacgtcgaaacgacgaccgacctaaccttattacgttgcgcgacacgacgtcgaacctaacgtctacgtaacgtttcgcgggggaccaacggggcccg

SEQ ID NO: 366668 - DNA, 624 bp, Homo sapiens
  misc_feature: GZ8MTXP02HYIWO.10.38.D05.1.454.CMB.2.raw
  modified_base (511)..(511): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctcgtggttcagcatcagtaacgactacatcgaccgtgggccccgccgagggcctccggaaggggaacggggcgtgggaggttcggggtctcgtaggttattagaaaacagactggaccacgtaactattactttattcgtagaccttccggtacgaaacggggtcccggttacaccccgtctaccgaaagacgacctaccttacccaaaacaacctattcctagtactcttacactatcgacaacattccnggacacggtacgacgaccgaacgccctaacttagttacgttggacgtcggacctacacgttcgaaacctaacgtcctacgtaaacgttccggcgggggaccaacgggaccccg

SEQ ID NO: 366669 - DNA, 595 bp, Homo sapiens
  misc_feature: GZ8MTXP02IJVZ7.10.38.D05.1.454.CMB.2.raw
  modified_base (356)..(356): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctcgggccccgccaggcctccgaaggggaacggggctgggagtgggtctcagttatgaaacngatggcatacattattattctgactcggtagtaacggggtcccgttccaccctctaccaaggtacacctaccttacccaaaacactattcttagtactcttacacctaagtcgacaactaatcgtagaacgtagtaccgaacgtacgacccggctaacctttaagttcgttggacgcggacaacaatcgtaaacctcgccttaacgtacgtttcggacgggggtacccagggggacccg

SEQ ID NO: 366670 - DNA, 605 bp, Homo sapiens
  misc_feature: GZ8MTXP02JK3KK.10.38.D05.1.454.CMB.2.raw
  modified_base (228)..(228): a, c, t, g, unknown or other
  modified_base (322)..(322): a, c, t, g, unknown or other
  modified_base (363)..(363): a, c, t, g, unknown or other
  modified_base (381)..(381): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgccactggaaccngcagtgactttgtgcttaataactatgtctcctggtaccagccaccacccaggcaaacgccccaaactcctttgtttgagtcagtaagcgcctnaggactcctagctcggtctctacgcctcaagtctggcaacnccggcctcctgacccgtntcgtgggtcctccgaggtcctaggaggtatggaggcgtagtaacttactacgtcgacacgcgactaattacgttaccgaacgaccccaaaggtacggggttgttcgggcgggtacggtacgtaacgggtcgtaccggtccgtcgggtaccacggacccgtaacggcccgtaccgcccccgttcggacctacccgttcggttcccgttaccccacccctttcccg

SEQ ID NO: 366671 - DNA, 550 bp, Homo sapiens
  misc_feature: GZ8MTXP02HKZY7.10.38.D05.1.454.CMB.2.raw
  modified_base (353)..(353): a, c, t, g, unknown or other
  modified_base (419)..(419): a, c, t, g, unknown or other
  modified_base (437)..(437): a, c, t, g, unknown or other
  modified_base (453)..(453): a, c, t, g, unknown or other
  modified_base (465)..(465): a, c, t, g, unknown or other
  modified_base (526)..(526): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccggcgtcgggggtccgtgagactctctgtgcacgcctctggttcagcatcagtaacgactacatcgaccgtggccccgccacggctccgagggaggggcgtggaggtggtcgtcagttattagaaacagancggcatacatattattctgactcgtgacggccggtcacctctcagacgacacttaccaacaaactntcttgtaatccttcaacnttgacacaatctaganacgtcgacgacncggaccctactattacttggtcgcgacgacagtcgaacctaccgaactcgaaatttccggnggggacccgaagggtacaccccgg

SEQ ID NO: 366672 - DNA, 638 bp, Homo sapiens
  misc_feature: GZ8MTXP02GU4KT.10.38.D05.1.454.CMB.2.raw
  modified_base (399)..(399): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaggtgtccactgtgaggttcaactggtggagacgtgggaggaggctggatccaggccgtgggggtccctggagactctcctgtgcagcctgtgggtcagcatcaagtaacgactacatcgacctcgggccccgccagggcctaccggaaggggaacggggcgtgggaggttcgggtctacgtagtttaagtagaaactagacgtggactaactactattaatttntcgtagtaccttccggtaggaaccggggtcccggtttaccaccccgttctaccgaaacgacgaaccctacttacccaaaaactactagttcttagtacttcttacgacatcacataacttcgagacgagtaccgaaacgaccacggtaccaactttactagtttcgacgacgacgtacagttacgaaccgtaacgtcctaaacgttaacttccggggacgggacccgaagggggccccg

SEQ ID NO: 366673 - DNA, 656 bp, Homo sapiens
  misc_feature: GZ8MTXP02HE2VC.10.38.D05.1.454.CMB.2.raw
  modified_base (377)..(377): a, c, t, g, unknown or other
  modified_base (444)..(444): a, c, t, g, unknown or other
  modified_base (464)..(464): a, c, t, g, unknown or other
  modified_base (484)..(484): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccgagccgtgggggtccctgagactctcctggtgcagcctcgtgggtcagcatcaagtaacgactacatcgaccgtcgggccccgccacgggcctaccgaagggggaaggggcgtagggaggtgggtctcgaggttaattagaaaacagtaagnggacactataattattaagttctagactccggtagaacggggtcccgtaccaccctatccaagaacncctactacgaaacaaacttntcgttatactctacgaactntacaactaaactacgtcgtagggaaactaccggtaacccggaaccgaaacccgaccccgtaccccttaaaactttacgtttaaggttccgacgacccggaactaaaccgtactaccgaaaccctccgacttaacgtaacggttccgggacggggaacccgtaacggggcccc

SEQ ID NO: 366674 - DNA, 616 bp, Homo sapiens
  misc_feature: GZ8MTXP02FL7MK.10.38.D05.1.454.CMB.2.raw
  modified_base (361)..(361): a, c, t, g, unknown or other
  modified_base (501)..(501): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctcgtgggttcagcatcagtaacgactacagtcgaccgtcgggccccgcgaggcctccgaaggggaagggcgtgggaggtgggtctcgtagttatagaaacngagtgacaacgtacaattattattctcgtacgtcggtaggaacgggtccgttaccacccgtctaccgaaggacgaacctaaccttacccaaaactactaacttccttagtacttcttacaaccattacgccaactaactntaacgagtacgtacgaccgtacgaccgtcctaacttaattacgttgacgccggacaactacgtacgaccgtaacgcttaactaacgttccgggtacggggaccctagggggaccc

SEQ ID NO: 366675 - DNA, 764 bp, Homo sapiens
  misc_feature: GZ8MTXP02GWOHN.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggtcagcatcagtaacgactacatgaccgtcgggccccgccaggcctccgaggggaaggggcgtgggaggtggggtctcgtagttatagaaacagatggcactacaattatttaattcgtacgtacgttcccggtagggtaacgggggtcccgggtttacccaacccccttctacccgaaggtaacgaaccctacctttaaccccaaaactaaaccctactttaccgtttacggttaaacctttaccctttaccaaaccgttaactaccggtaccctaaaaccttaaacttacccgttaaggaacggtaaccgggttacccggaaaacccgggacccaaacccgggggtacccccttaaaccccgttaacgttttaacgtttcggtttaccgggcccggtaccgtaaaccgtaacgttacggtaacccgttaacccggtacctttaaccgtaaacggttttacccggacggggggtaccccgtaaggggggtaacccccgg

SEQ ID NO: 366676 - DNA, 718 bp, Homo sapiens
  misc_feature: GZ8MTXP02I4HVO.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtgggttttcctgttgctatttcaaaaggtgtccactgtgaggttcaactggtggagactggaggaggctggatccagccgtggggggtccctgagactctcctgtgcagcctgtggtcagcatcaagtaacgactacatcgaccgtcgggccccgcgaggccgtccggaaggggaggggctgggaggtgggtctcgtagttatagaaacgagagtcggacctacttactattaactttattctcgtaaccgtccggttacggggaaaccgggggttccccggttaccctacccccgttctacccgaagaacgtaaccctacccttaacccaaaactaaccttacgttacctttagtacttccttaccaacgtattcacctaactacgttaccaggtaacgtacggttaccgaaaccgaccgtaaccgggtaccccttaacctttaaagtttacgtttacggttcggtaccggaccttaaccggaactttccggaaacccttaacccggtaacctttaccgtaaaacggttccggtaacccgggggacccggttaacggggaaaccccgg

SEQ ID NO: 366677 - DNA, 648 bp, Homo sapiens
  misc_feature: GZ8MTXP02GR3RO.10.38.D05.1.454.CMB.2.raw
  modified_base (482)..(482): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtggttcagcatcagtaacgactacatcgaccgtcgggccccgccgacggcctaccggaggggaaggggcgtgggaggtgggtctacgtagtttagtagaaacgagacgtggacactactattatttattctacgaccgtcggtaggaaccggggtcccgttacctacccgtcctacgaaacgacgaacctacccttaacccaaacaacctattaccgttntaacttccttaacactatcgaaccaacctattcgaaggaacgtacggtacgaaaccgtaccgacccggaacccttaacctttagttacgtttcggacgaccggacaactacgtacgaacctaacgtccttacgtaacgttccggacggggacgaaccgggacccgg

SEQ ID NO: 366678 - DNA, 637 bp, Homo sapiens
  misc_feature: GZ8MTXP02HNP7F.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtgggggtccctgagactctcctgtgcagcctgtgggtcagcatcaagtaacgactaacatcgaccgtcgggccccgccagggcctccggaggggaaggggcgtgggaggttgggtctacgtaggttattaggaaaccagagtcggactactaactattaactttatcgttacgaaccgttcggtacggtaacgggggtcccgtccaccccgtctacccgaacggacgaacctacgttacccaaaacgactagttccttagtactcttacactatacgactaacatcgtagaacgacgtaccgaacgacaccggtacctacgttacgttatttcggacgtccgtacgacctatacggactaaccggacttacgtaaacgttccggacggggaccgtaggggaaccccg

SEQ ID NO: 366679 - DNA, 652 bp, Homo sapiens
  misc_feature: GZ8MTXP02H2VA4.10.38.D05.1.454.CMB.2.raw
  modified_base (252)..(252): a, c, t, g, unknown or other
  modified_base (298)..(298): a, c, t, g, unknown or other
  modified_base (512)..(512): a, c, t, g, unknown or other
tcagcatagtagtgcacgaccggtgctcgatttagtatctgatagttgggttggggggagaggagcccagcactgggattccgaggtgtttccattcggtgatcagcactgaacacagaggactcaccatggagtttggctgagctgggttttccttgttgctatttcaaaaggtgtccactgtgaggttcaactggtggagactggaggaggctggactccagccggtgggggtcctgagctctctgtgcngcctcgtggtcagcatcagtaacgactacatcgaccgtcgggcccnccgacggcctaccggaaggggaacggggcgtggggaggtcggggtctacgtaaggtttataggaaaacgagaacgtcggactaactatatttattatccgttacgtaccgttccggtaggaaccggggtcccgttacccaccccgtactacccgaaagtaccgaaccctaccttaacccaaactaactacttcttagtacttccttacgaactntcgaacctaactaagtcctaggacgtacggaccgacccgaaccaccggaccctaaacgtttatacgttggacgccggacaacattacggaacctaaccgtctaacgtaacgttcggggacgggaccgaacgggggacccg

SEQ ID NO: 366680 - DNA, 652 bp, Homo sapiens
  misc_feature: GZ8MTXP02H7GDG.10.38.D05.1.454.CMB.2.raw
  modified_base (369)..(369): a, c, t, g, unknown or other
  modified_base (586)..(586): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttcaaaaggtgtccactgtgaggttcaacgtggtggagactgggaggaggctggactccgaggccggtgggggtccctgagactctctgtgcacgcctgtggtcagcatcaagtaacgactacatcgaccgtcggcccgccgagggcctaccggaggggaaggggcgtagggaggttgggtctcgtagttataggaaacngacgtggactactactattagttacttctcgtacgtccggtaggtaaccggggtcccgtcaccccctcgtaacccgagtaccgacctaacctacccaaacgtaactattccttacgtacttacctaacacgtattcgaactaactaacttcgaacggaagtaccggtaccgacgaaacccgtaccggccctaaaacctttagttacgtttcgggacncgggtaaccagtacgtcgaaacctccgactaccgtaagttccggcggggaccggtaaacggccccg

SEQ ID NO: 366681 - DNA, 582 bp, Homo sapiens
  misc_feature: GZ8MTXP02FPKM7.10.38.D05.1.454.CMB.2.raw
  modified_base (454)..(454): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatgaccgtgggccccgccgacggctccgaggggaacggggcgtgggaggtggggtctcgtagttatagaaaccagagtggactactactattattactctagacctccggtaggaacggggtcccgttacacccttctaccgaagacgaccaccttacccaaanaactagtcttagtattccttacacatacgacaacgaatcgtagagtacgtcgaacgtacaccggcctacttattacgtgtacgcgacgatacgtcgactacgctctaacgttcggacgggggaacccg

SEQ ID NO: 366682 - DNA, 582 bp, Homo sapiens
  misc_feature: GZ8MTXP02H0H5F.10.38.D05.1.454.CMB.2.raw
  modified_base (373)..(373): a, c, t, g, unknown or other
  modified_base (413)..(413): a, c, t, g, unknown or other
  modified_base (417)..(417): a, c, t, g, unknown or other
  modified_base (465)..(465): a, c, t, g, unknown or other
  modified_base (480)..(480): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggtttccttgttgctatttcaaaaggtgtccactgtgaggttcaactggtggagactggaggaggctggatccagccgtgggggtccctgagactctctgtgcagcctctgggttcagcatcagtaacgactacatcgacctcgggcccgccaggcctccgaaggggaaggggctaggggaggtggggtctacgtagttaattagaaaacagagtggacactanattattattctagactccgtgaacgggtccgtcaccctcnccanacgacctacttacccaaacaactatcgttatattccttacgaactatnacctaactaacgttntagacgtacgtaccgacgaccgaccgacctacttattacgtcgacgcgactactacgtacgtacctaacgctacgtacgtacggacgggaccgaacgggccg

SEQ ID NO: 366683 - DNA, 659 bp, Homo sapiens
  misc_feature: GZ8MTXP02IAVF1.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcggaccgtcgggccccgccgacggcctaccggaaggggaaggggcgtgggaggtggggtctcgtagttattagaaacagacgtggacactacattattattctagtactccgtaggaacgggtcccgtactaccccctctacccgaagacgtacctacccttaacccaaaacaacctactttcttacgttactacttacaacgtatacgacaaactaatcgtaaggacgtaacggaccgaaaccggaacccgacccggtaccctaaaacccgtttatttaacgtttcgggacgaccggacaacctaggttacctaaaccgtaacccgtctaacgtaacgtttccggcgggggaccctaaggggaccccg

SEQ ID NO: 366684 - DNA, 648 bp, Homo sapiens
  misc_feature: GZ8MTXP02GXCWM.10.38.D05.1.454.CMB.2.raw
  modified_base (261)..(261): a, c, t, g, unknown or other
  modified_base (301)..(301): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctntgggttcagcatcagtaacgactacatgacctcgggcccncaggctccgaggggaagggctggagtgggtctcgagttatagaaacagatggacactacattattattctagacttccggtagaacgggggtcccgttccaccccttcacccaggtacaacctaccttacccaaacaaccattaccgttagtaactccttacaacgtatacgaccaactaaactccgtagaacggtacgttccgaaacccgtaacgacccggtaccctaaacccgtttaatttagtttcgggacgaccggacggtaaccgtacttacggaacccttaaccggacttaccgtaaaacgtttccgggtaccgggggaaccccgaagggggtaacccccg

SEQ ID NO: 366685 - DNA, 592 bp, Homo sapiens
  misc_feature: GZ8MTXP02I2FBP.10.38.D05.1.454.CMB.2.raw
  modified_base (353)..(353): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtggtcagcatcagtaacgactacatcgacctcgggccccgccaggcctccggaggggaaggggcgtgggagtgggtctcgagttatgaaacngactggacactactattattattctcgacttccgtagaacgggtccgttaccacccctctaccagtacacctaccgttacccaaaactacattccttagtactcttacactatcgaccaataactcgtagacgacgtaccgaacgaccacgaccctaacgtttattagttcgacgccgacgaacctagtacgaacctaacgtcctaacgtacgttcggtacggggcccaaagggccccg

SEQ ID NO: 366686 - DNA, 702 bp, Homo sapiens
  misc_feature: GZ8MTXP02HUWWN.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtgggggtccctgagactctcctgtgcagcctgtgggtcagcatcagtaacgactacatcgaccgtcgggccccgccgacggtccgtaccggaagggggaacggggcgtggggaggtttcggggtactcgtaagttaagttacggaaaacgagacgtcggacctaacttaacctaattaacgtttaactttccgtacggtaacccttaccgggttacggggaaaccgggggttccccggttaccctaacccccttcgtaacccgaaggaaccgtaaccctaacctttaacccaaaactaacctagtttcctacgttactccttacacctagtacacaactataccgtgaacgtagtaccgaacgaccaaccggtcctaaacctttagttacgtttcgcgaccgacgactaacgtcgtaacctaacgtacttaacgtaacgttccggtacgggggccgaacgggggtaccccg

SEQ ID NO: 366687 - DNA, 647 bp, Homo sapiens
  misc_feature: GZ8MTXP02JR682.10.38.D05.1.454.CMB.2.raw
  modified_base (354)..(354): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctgggccccgccgaggcctccgaggggaagggctgggagtgggtctcgagttatagaaacngatggcactacatattatctagactccggtagaacgggtcccgttacaccctcaccgagacgacctaccttacccaaactaactacttcttagtacttccttacactatcgacctaactaacgttccgtagaacggtaacgtaccggaaccggtaaccgaacccgggtacccctaaaccgttaatttacggttcgtacggacccggtacggtaacctacgtacggtaccgttaaccggccttaacgtaaacggtttccggggacgggggtaccccggaaggggtaacccccgg

SEQ ID NO: 366688 - DNA, 671 bp, Homo sapiens
  misc_feature: GZ8MTXP02IR2OF.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtgggaggaggcgtggactccgagccggtgggggtccctgagactctcctgtgcacgcctcgtggttcagcatacaagtaacgactacagtcgacccgtcggggccccgcgacggccgtacggaagggggaaggggcgtaggggtacggtcgggtctacgtagtttaagtagaaaacgaggtagtacggactactaactattactttatcgtgtacctccggtacggaacggggtcccgtacctacccttcgacccgaagtacgaacctaaccttaacccaaaactacgtacttccttagtacttccttacgacatcgacaactactcgtacgagacgtaccgacgaccgaccggaccctaactttagtttaacgtcgggtacgaccgacgtaacgtactaccggtaaaccctgtaccctaacgttacggttccggaccgggggacctaacggggggacccc

SEQ ID NO: 366689 - DNA, 684 bp, Homo sapiens
  misc_feature: GZ8MTXP02GIF05.10.38.D05.1.454.CMB.2.raw
  modified_base (242)..(242): a, c, t, g, unknown or other
  modified_base (245)..(245): a, c, t, g, unknown or other
  modified_base (310)..(310): a, c, t, g, unknown or other
  modified_base (531)..(531): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctattcaaaggtgtccactgtgaggttcaactggtggagactgggaggaggctggatccagccggtcgggggtcccnganactctcctgtgcacgtctcgtggttcagcatacaagtaaccgactacatcgaccgtcgggccccnccgaggctaccggaggggaacgggcgtaggggaggtcggggttacctcgttaagtttagtaagaaaacgaggtaactcgggactaactaactatttaatttacttcgtcgtaaccgttccggtagggtaaaccggggtcccggtttaccaccccgttcaaccgagtacgaaccctaaccttacccaaaactactatttccttagtactccttacaacgtanctaccaaattaacgtctaacgaaggtacgtcccgaaacgtacccgacgacccttaaacgtttagttacggttgacggaccggacaacgtaaagttccgaacttaaccggtccctaagtaacgttcgggccgggggaccgtacgggggaacccg

SEQ ID NO: 366690 - DNA, 589 bp, Homo sapiens
  misc_feature: GZ8MTXP02IIXDR.10.38.D05.1.454.CMB.2.raw
  modified_base (357)..(357): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtcctgagactctcctgtgcagcctctggttcagcatcagtaacgactacatcgaccgtcgggcccgccaggcctccggaaggggaaggggcgtgggagtggggtctcgtagttattagaaacngatggcactacattattattctgactccggtagaacggggtccgttccaccctctacagagacctacctaccaaacactattcttagtacttcttacaacatcgaccaactaatctacgagacgtacgaaccgaccaccggaccctaaccttaattacgttggtcggacgacgtacaagtcgtaacctaacgacttacgtaacgttcggtcgggggaccctagggggacccg

SEQ ID NO: 366691 - DNA, 545 bp, Homo sapiens
  misc_feature: GZ8MTXP02F4SZE.10.38.D05.1.454.CMB.2.raw
  modified_base (349)..(349): a, c, t, g, unknown or other
  modified_base (425)..(425): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtggggggtccctgagactctcctgtgcagcctctgggttcagcatcagtaacgactacatgacctggcccgccaggctccgaggggaaggggctggagtgggtctcgagttatgaaacngactggcactacatattattctagactccgtgaacggggtccgttcaccctctccagacacacttccaaacaactntcttgtaactcttacacatcgacacaaagtctagacgagtcgaacgacacggccaaccttattacttgcgccgcgacagtgaaacctaacgctacaactttcgcggggaccagggacccg

SEQ ID NO: 366692 - DNA, 619 bp, Homo sapiens
  misc_feature: GZ8MTXP02HAB8D.10.38.D05.1.454.CMB.2.raw
  modified_base (256)..(256): a, c, t, g, unknown or other
  modified_base (302)..(302): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtcctgagactctctgtgcngcctcgtggtcagcatacagtaacgactacatcgacctcgggcccncgaggcctccggaggggaagggcgtgggaggtgggtctcgtagttacgtagaaactagatcggacactactattattaattctgactccgtagggtaacgggtccgttccacccctctcccgaaagtacgacctaaccttaacccaaataacctacttctttagacttccttaccataactcgtacaaactactctagaaggtaacgtaccgaacgaccgtaccggtacccaaacctttagtagtttggacgcgtaccgactacgtcgaaccttaacgccctaagtacgttcggacggggacccgaaggggaccccg

SEQ ID NO: 366693 - DNA, 557 bp, Homo sapiens
  misc_feature: GZ8MTXP02GXSWA.10.38.D05.1.454.CMB.2.raw
  modified_base (300)..(300): a, c, t, g, unknown or other
tcagcatagtagtgcacgaccggtgctcgatttagtatctgatagttgggtttggggggagaggagcccagcactgggattccgaggtgtttccattcggtgatcagcactgaaaacagaggactcaccatggagttttggctgagctgggttttccttgttgctatttcaaaaggtgtccatgtgaggttcaactggtggagactggaggaggctggatccagcctggggggtccctgagactctcctgtgcagcctctgggttcagcatcaagtaacgactacatgacctgggccccncaggctcgaggggaaggggctggagtgggtctcagttatagaaacagatggcactacatattattctgactccggtgaacggggccgttcaccctctccagacaccacttacccaaaacaaacattcgttagtaactcttacaacagttcgacacaaatactagagagacgacgaacgaccggaccaccctaacttaacttgttgcgcgacactacgacacaacgtactaacgtacgtacggacggacggacgaccg

SEQ ID NO: 366694 - DNA, 592 bp, Homo sapiens
  misc_feature: GZ8MTXP02G1D11.10.38.D05.1.454.CMB.2.raw
  modified_base (443)..(443): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtggtcagcatcagtaacgactacatcgacctcgggccccgccagggctccgaggggaaggggcgtgggagtgggtctcgtagttagttagaaacagatggactactacatattattctgactccggtagaacgggtccggtccacccgtctccgaagacgacctacttacccaaacaacncttcttagacttccttaccactatcgacaactaagtctagagacgtaccgaacgaccacggccctaaactacttatttcggcgaccgacgacacgtcggaacctaacgcctaactaacgtccggtacgggggacccgaaggggtacccg

SEQ ID NO: 366695 - DNA, 585 bp, Homo sapiens
  misc_feature: GZ8MTXP02JOIR2.10.38.D05.1.454.CMB.2.raw
  modified_base (301)..(301): a, c, t, g, unknown or other
  modified_base (346)..(346): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggtttcaactggtggagactggaggaggctggatccaggccgtggggggtccctgagactctcctgtgcagcctcgtgggtcagcatcagtacgactacatgacctggccccncaggctcgaggggagggctgggagtgggtctcagttatagaaacngatggcactacatattatctgactccggtgaacgggccgttcaccctctccagacgaccacttaccaaacacagtcttgactcttacacatcgacactaatcgtaggaacgagtccgaacgaccgaccgtacccaaacgtttatttacgtttggcgaccggacgtaacagttacggaaccttaaccggactttacccgaaaagtttccggacggggggacccctaagggggaacccccg

SEQ ID NO: 366696 - DNA, 627 bp, Homo sapiens
  misc_feature: GZ8MTXP02I33HP.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggagctggatccagccgtggggggtccctgacgactctccgtgtgcagcctgtgggtcagcatcagtaacgactacatcgacctcgggcccgccaggctcgaggggagggctgggagtgggtctgtagttagttagaaacagacgtggaccaactacattattaacttcgtagtaccgttaccggtacggaacggggtcccgttccaaccccgtcctaccgaagacgtaacctaccttacccaaactaacctattcttagtactcttacactatacgtacactaagtcctagagtacggtaccgaacgaccaaccggtccctaaaacctttattaacgttcggtcgaccgtacgaacctagttcgaaccgttaacgccttacgaaacgttcgggacggggccgaaggggaaccccg

SEQ ID NO: 366697 - DNA, 826 bp, Homo sapiens
  misc_feature: GZ8MTXP02I69BN.10.38.D05.1.454.CMB.2.raw
tcagcatagtagtgcacgaccggtgctcgatttagtatctgatagttgggtttggggggagaggagcccagcactgtgattccgaggtgtttccattcggtgatcagcactgaacacagaggactcaccatggagttttggctgagcttgggttttccttgttgctatttcaaaaggtgtccactgtgaggttcaactggtggagactgggaggaggctggatccaggccgtgggggtccctgagactctcctgtgcagcctcgtgggttcagcatcagtaacgactacagtcgacccgtcgggccccgccgacggcctaccggaaggggaacggggtcgtaggggacggttggggtctcgtaagtttattaggaaacaggtatacggactaacgttactaagttaactttacgtttccgtacggtaacccgttacccgggtaggggtaaaaccgggggttcccccgggtttaccccaaacccccgttcccgttaaacccccgaaaggggtaaacccgtaaacccttaaacccgtttaaaacccccaaaaacccgtaaaaccctttaacttttacccccggttttaagtttaaacccttttacccttttaaaccccgaaacttaaaacggtttccgaaaccccttaaaccttaaaacgttcccggttaagggaaaccggtaacggttaacccgggaaacccgaaaccgtaacccgggtacccccttaaaccgtttaagtttaacgttcgggtacgaccggtacgaactaagttacgaaccttacggaccttacgaaacgtttccggacgggggacccaaacggggg

SEQ ID NO: 366698 - DNA, 577 bp, Homo sapiens
  misc_feature: GZ8MTXP02GCL8J.10.38.D05.1.454.CMB.2.raw
  modified_base (359)..(359): a, c, t, g, unknown or other
  modified_base (379)..(379): a, c, t, g, unknown or other
  modified_base (406)..(406): a, c, t, g, unknown or other
  modified_base (447)..(447): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaaggtgtccactgtgaggttcaacgtggtggagactggaggaggctggatccagccgtgggggtccctgagactctcctgtgcagcctcgtgggttcagcatcagtaacgactacatcgaccgtgggccccgccgaggcctccgaggggaacggggctgggagtgggtctcgtagttatgaaacngagtgcatacatattattcngactccgtagacgggtccgtcaccctntaccgagacgacacttaccaaacactatcttgactctcacntcgacaactaatctagagtcggtcgaacgacgaccggacctaaccttaatttacgttgacggtacgacgaactagtcgaaaccttaaccgacttactaaacgttccgtacgggggacccagggggacccg

SEQ ID NO: 366699 - DNA, 650 bp, Homo sapiens
  misc_feature: GZ8MTXP02FMYDM.10.38.D05.1.454.CMB.2.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactgggtggagacgtggaggaggctggatccgaggccgtcgggggtccctgacgactctcctgtcgcacgcctcgtgggtcagcatcaagtaacgactacagtcgaccgtcgggccccgccgacgggccgtaccggaaggggacggggcgtgggaggtcgggtctacgtaagttactagaaacgagacgtcggacctaactactattatttacttcgtacgtaccgtccggtaggaaccgggtcccgtaccaccctcgtaccgacgacgaacctaccttaacccaaacaacctattcttagtacttccttacactacgtcacctaaactacgttctaggagtacggtaccgaaccgaccgaccggtacctaaccgttattacgttgcgtaccgacgactacgtacgaaccgtaacgtctacgtaacgttccggacgggacccgtacgggacccg

SEQ ID NO: 366700 - DNA, 590 bp, Homo sapiens
  misc_feature: GZ8MTXP02H7NK6.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggttcagcatcagtaacgactacatcgaccgtcgggcccgccaggctccggaggggaaggggctgggaggtgggtctcagttatagaaacagatggactactacattattattctgtacctccggtacggaacggggtcccgttactaccctcctccacggacacctactacccaaacactattacttgtactcttacactatcgacacaatcgtagagtacgtacgacgaccacggtacctaaccgttattacgtggtcgcgtacgactacgttcgaccgtaacgtctaaccgtaagttcggtccggggacgtaaacgggcccg

SEQ ID NO: 366701 - DNA, 606 bp, Homo sapiens
  misc_feature: GZ8MTXP02JSHL1.10.38.D05.1.454.CMB.2.raw
  modified_base (338)..(338): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctgggccccgccaggctccgaggggaggggctgggagtgggtctntagttattagaaacagatggacactacatattattctgactccgtagaacgggcccgttacacccctctcccgaagacgacctaccttacccaaacaaacctattccgtttagtacttccttacaacgtatcgacaactaatacgtgagtacggtacgaaccgaccgaccggtaccccacgtttaaactttgttggccgaccggacaacgtactcgaacctaaccgcttaccaaacggtttcggacgggggaccgaacgggggacccc

SEQ ID NO: 366702 - DNA, 588 bp, Homo sapiens
  misc_feature: GZ8MTXP02FURDM.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggtcagcatcagtaacgactacatcgacctcggccccgccgaggctccgaggggaacggggctgggagtggggtctcgtagttattagaaacagactggacactacattattattctcgactccggtagaacggggtcccgtttaccacccttctacccgagacgaacctacttacccaaacaactattcttagtacttccttacactatcgacaactaatcgtagagagtcgacgacgaccgacctaacttatactttggcgaccgacgactatggaacctaacgcttacgtaacttccggacggggaccgaggggaacccg

SEQ ID NO: 366703 - DNA, 600 bp, Homo sapiens
  misc_feature: GZ8MTXP02FHGX5.10.38.D05.1.454.CMB.2.raw
  modified_base (394)..(394): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcggaccgtcgggccccgccgagggcctaccggaagggggaaggggcgtgggaggtggggtctcgtaagttataggaaacagactggacactacattattattcngaccttcggtaggaacggggtcccgttaccaccctcgtccaagacgacctaccttacccaaacaactattctttagtacttcttacactatcgaacactaaatctagaagtacgtcgaacgtacaccggtacctaaccttatttacgtgtcgacgtacgacctatcgactaacgctacgacttccggacggggaccagggtacccg

SEQ ID NO: 366704 - DNA, 564 bp, Homo sapiens
  misc_feature: GZ8MTXP02JE810.10.38.D05.1.454.CMB.2.raw
  modified_base (170)..(170): a, c, t, g, unknown or other
  modified_base (215)..(215): a, c, t, g, unknown or other
  modified_base (265)..(265): a, c, t, g, unknown or other
  modified_base (345)..(345): a, c, t, g, unknown or other
  modified_base (373)..(373): a, c, t, g, unknown or other
tcagcatagtagtgcacgaccggtgctcgatttagtatctgatagttgggtttgggtgccgaagttgctggaggtcacggtcaccacgctgctgagggagtagggtccctgagactctcctgtgcagcctctgggttcagcatcagtaacgactacatgacctgggcccncaggctcgaggggaaggggctggagtgggtctcagttatgaaacngatggcactacatattattctgactccgtagaacgggtccgttcaccctntccagagacacttccaacaacatcttgtaatcttcacatgcaacaatctgagagtcgacgacaccggccactattatgtncgcgacatcgactacgctacaatttcgnggggccgagggcacccgaggtccaccggtccctccccaccgccctacccaccgaacgggcccaacgtcccggtccttcccccgtggtcccgtcccgtcgccgtccgacggacgccaccctaccgacgacgcacgacgccggcccgcgggcctcgccgtcggtcgaacggacctacctcccaactactatcg

SEQ ID NO: 366705 - DNA, 634 bp, Homo sapiens
  misc_feature: GZ8MTXP02ILT8L.10.38.D05.1.454.CMB.2.raw
  modified_base (519)..(519): a, c, t, g, unknown or other
  modified_base (540)..(540): a, c, t, g, unknown or other
  modified_base (580)..(580): a, c, t, g, unknown or other
  modified_base (616)..(616): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgttgggttttccttgttgctatttacaaaaggtgtccactgtgaggttcaacgtggtggagacgtggaggaggctggatccgagccggtgggggtccctgagactctcctgtgcagcctgtggtcagcatcagtaacgactacagtcgaccgtcgggccccgccgacgggcctaccggaggggaaggggccgtagggacggttgggtctacgtagttagtagaaacgagagtcggactactataattagttacttcgtacgtaccgttaccggtacggtaaaccggggtcccgttacctaccccctcgtacccgaaggtacaacccttaccttaaccaaaacctatacgttccttagtacttctacgactntacgacaactatcgagaacgngtacgacgtaccacgtccctaaactttattacgttggacnccggtacacctagtcgaactcgtctactagtccggnggggaccctaaggccccg

SEQ ID NO: 366706 - DNA, 630 bp, Homo sapiens
  misc_feature: GZ8MTXP02HK96L.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtggttcagcatcagtaacgactacatcgaccgtcgggccccgccgaggccgtccgaaggggaaggggcgtgggagtgggtctcgtagttatagaaacagatcggacactactattattattctacgtactccgtaggaaccgggtccggttccacccctcgtaccagacgaacctaccttacccaaactaacctattccttagtactcttacaactatacgtacaactatcgtaggaagtacggtaccgaaccgtaccgaccggtacccctaaccgtttattagttcggtcgaccggtacgaacctagttacgaaaccttccgacttacgtaacgtttccgggacgggggacccgtaagggggaccccg

SEQ ID NO: 366707 - DNA, 584 bp, Homo sapiens
  misc_feature: GZ8MTXP02GMRDS.10.38.D05.1.454.CMB.2.raw
  modified_base (303)..(303): a, c, t, g, unknown or other
  modified_base (311)..(311): a, c, t, g, unknown or other
  modified_base (407)..(407): a, c, t, g, unknown or other
  modified_base (432)..(432): a, c, t, g, unknown or other
  modified_base (440)..(440): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcgtggtttcgtgtagctattcaaaaggtgtccactgtgaggttcaactggtggagactggaggaggctggatccagccgtggggggtccctgagactctcctgtgcagcctcgtgggttcagcatcaagtaacgactacatgacctcggggccccncgagggcnccgaggggaacggggctgggaggtggggtctcgtagttatagaaactgaagtgcatactatattatctgactccgtgaacgggtccgtccaccctnaccgaggacactaaccttcccaaanaaccgttnttacgttgttactactactactactacacactactacgtacgacgacgtacgaacgaaccgaccgacctaacttacttagttcgtcgcgacgacgtacgtacgtacgtaacgtactacgtacgttacggtcggacggacggacg

SEQ ID NO: 366708 - DNA, 655 bp, Homo sapiens
  misc_feature: GZ8MTXP02JIY48.10.38.D05.1.454.CMB.2.raw
  modified_base (257)..(257): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagctctcctgtgcngcctcgtgggtcagcatcagtaacgactacatcgaccgtcgggccccgccgaggccgtccggaaggggaacggggtcgtggggtaggtcggggtctacgtagttagtagaaaacagacgtggacctactaactattattacttcgtgtaccgtccgggtagaaccggggtcccgttaccaccccgtcctaccgaacggactaaccctaccttaacccaaacaacctacttacttagtacttcttaccaactatacgaccaactaacttccgtagacggtacgtacgaaccgtaaccgaccggtaccctaaccgttaatttacgttcgtacggccgacgactacgtcgtaaccgaaccgtcttaaccggtacgttccggcggggacccgacgggacccg

SEQ ID NO: 366709 - DNA, 603 bp, Homo sapiens
  misc_feature: GZ8MTXP02IQONR.10.38.D05.1.454.CMB.2.raw
  modified_base (351)..(351): a, c, t, g, unknown or other
  modified_base (427)..(427): a, c, t, g, unknown or other
  modified_base (435)..(435): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggccccgccaggcctccgaggggaaggggctgggagtgggtctcagttattgaaacngatggcactacattattatcgtgactccggtgaacggggtccgtctaccctctccagacgacctacttacccaaanaaaccttnttactatactacctacactatcgtacaactaagtcgtagaacgtacgtaccgaaccgaccgaaccgtaccctaacgttagtttacgttcggcgtaccggacgtaacgtacgtacgaacctaacgtcctaacgttacgttccgggaccgggggtaccgaacgggtcccg

SEQ ID NO: 366710 - DNA, 637 bp, Homo sapiens
  misc_feature: GZ8MTXP02GPVG5.10.38.D05.1.454.CMB.2.raw
  modified_base (450)..(450): a, c, t, g, unknown or other
  modified_base (592)..(592): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccaggccgtgggggtccctgacgactctcctgtgcagcctcgtgggtcagcatcagtaacgactacatcgaccgtcgggccccaccgaggcctcccgaagggggaacggggctaggggaggtggggtctacgtagtttaatagaaaacagagtggaccaactactattaactttagttcgtacgtaccgtccggtaggaaccggggtcccggttaccacccccgtntcccgaaaggacgactaacccttaacccaaaactaacctagttcctttagacttaccttacaaccgtatacgacaaactagtactagagacggtaccgaacgaccgaccgacctaacgttagttacgttgacggcacgtacncgtacgacctcgacctagtaacgttcggacgggaccgaggggacc

SEQ ID NO: 366711 - DNA, 561 bp, Homo sapiens
  misc_feature: GZ8MTXP02HYZSL.10.38.D05.1.454.CMB.2.raw
  modified_base (302)..(302): a, c, t, g, unknown or other
  modified_base (430)..(430): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctgtgggttcagcatcagtaacgactacatgacctcgggccccnccaggctccgaggggaggggctgggagtgggtatcgagttattagaaacagatggcactacatattatctgactccgtgaacgggtccgttcaccctctccagacgaaccaccttaccaaaacaactnttcttgtactcttcactatgacactaatcgtagagagtccgaacgaccgacggaccctaaccttatttacgttgtcgccgacgacactcgacctaacgcctactacgttcgcgggggacctagggggaccc

SEQ ID NO: 366712 - DNA, 713 bp, Homo sapiens
  misc_feature: GZ8MTXP02H9R5T.10.38.D05.1.454.CMB.2.raw
  modified_base (552)..(552): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgtaggttcaacgtggtggagacgtgggaggaggcgtggatccgaggccggtgggggtccctgagctctcctgtgcagcctcgtgggttcagcatacgaagtaacgactacactcggaccgtcgggccccgccgacgggcctaccggaagggggaggggtcgtaggggtaggttcggggtctacgtaggtttaattacggaaaacgtaggagtacgggacctaaactaactaatttaactttaactttccgtacggtaaaccgttcccgggtaagggtaaacccgggggttcccccgttaccgtacccccctacctaccgaaggtaaccgtaacccttacccttaaacccaaaacttaaacctnttacgtttatacttacttacaacctatacgacctaaactaactcgtagacgtacgtaccgaaccgacgacccgtactaaccttagttcttggacgaccgtacactacgtcgaacttaaccgcttaacgtaacgttccggggacgggaccgaaggggccccg

SEQ ID NO: 366713 - DNA, 555 bp, Homo sapiens
  misc_feature: GZ8MTXP02IAK6R.10.38.D05.1.454.CMB.2.raw
  modified_base (365)..(365): a, c, t, g, unknown or other
  modified_base (442)..(442): a, c, t, g, unknown or other
  modified_base (451)..(451): a, c, t, g, unknown or other
  modified_base (459)..(459): a, c, t, g, unknown or other
  modified_base (468)..(468): a, c, t, g, unknown or other
  modified_base (472)..(472): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcgtgggttttccttgttgctatttcaaaaggtgtccactgtgaggttcaactggtggagactggaggaggctggatccagccgtggggggtccctggagactctcctgtgcagcctctgggttcagcatcagtaacgactacatgacctcgggccccgccagggtcctcccgaaggggaaggggcgtgggagtggggtctcgagtttaattgaaacngatggcactacattattattctgacctccggtagacggggaccggtttccaccctctccaggacacacttacccaanactatcttntatcttanacatcacanatgngagcgcgaacgcacgactacttattatgcgacgacgacacgtacgactcgactacgtacgtcggaccgggaccgacgggtacg

SEQ ID NO: 366714 - DNA, 581 bp, Homo sapiens
  misc_feature: GZ8MTXP02F9GFC.10.38.D05.1.454.CMB.2.raw
  modified_base (258)..(258): a, c, t, g, unknown or other
  modified_base (365)..(365): a, c, t, g, unknown or other
  modified_base (408)..(408): a, c, t, g, unknown or other
  modified_base (414)..(414): a, c, t, g, unknown or other
  modified_base (419)..(419): a, c, t, g, unknown or other
  modified_base (431)..(431): a, c, t, g, unknown or other
  modified_base (437)..(437): a, c, t, g, unknown or other
  modified_base (446)..(446): a, c, t, g, unknown or other
  modified_base (448)..(448): a, c, t, g, unknown or other
  modified_base (452)..(452): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagactggaggaggctggatccgagccgtgggggtccctgagactctcctgtgcngcctcgtggtcagcatcagtaacgactacatcgaccgtcgggccccgcagggcctaccggaggggaacggggtctgggtaggtgggtctcgtaagtttatagaaacngatcggcactacattattattcagactcgtagacgggtcgtcnccctcncaganacactaccacanatcttnactctcacntnacanatctagagacgtccgaacgaccaccggcctaaccttatttacgttggtacgtacgacgtaactataccggtaactaaccgtaccgttactaaacgttccgggtacgggggacccgaagggggtaccccg

SEQ ID NO: 366715 - DNA, 582 bp, Homo sapiens
  misc_feature: GZ8MTXP02GL9GZ.10.38.D05.1.454.CMB.2.raw
  modified_base (301)..(301): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggcccncaggctccgaggggaagggctggagtggggtctcgagttatagaaacagactggcactacattattatctagactccggtggaacggggtcccgttacaccccgttctcccgagacgaacctaccttacccaaacaactattcttgtactcttacactatgtaccataatctagagtagtcgacgacgaccggaccctaaccgttacttagttagtcgtccgacgacacgtcgaactaaccgcttaacgaacttccggtacggggcccgaggggaacccgg

SEQ ID NO: 366716 - DNA, 539 bp, Homo sapiens
  misc_feature: GZ8MTXP02HE0E5.10.38.D05.1.454.CMB.2.raw
  modified_base (350)..(350): a, c, t, g, unknown or other
  modified_base (407)..(407): a, c, t, g, unknown or other
  modified_base (421)..(421): a, c, t, g, unknown or other
  modified_base (495)..(495): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtcctgagactctcctgtgcagcctctgggttcagcatcagtaacgactacatgacctgggccccgccaggctccgaggggaaggggctgggaggtgggtctcgagttatgaaacngatggcactacattattattctgactccgtagaacgggtccgtcaccctctccaganacacttacccaaanacatcttgactcttacactagtcacaacatctagagagtcgaacgacacggccacgttattattgcgcgcgacngtacgactaacgctactaacttcggacggggacccagggacccg

SEQ ID NO: 366717 - DNA, 591 bp, Homo sapiens
  misc_feature: GZ8MTXP02HGOOE.10.38.D05.1.454.CMB.2.raw
  modified_base (236)..(236): a, c, t, g, unknown or other
  modified_base (299)..(299): a, c, t, g, unknown or other
  modified_base (458)..(458): a, c, t, g, unknown or other
tcagcatagtagtgcacgaccggtgctcgatttagtatctgatagttgggtttggggggggtctcaggaggcagcgctctcagggcgtcaccaccatggcctgggctctgctattcctcaccctcctcactcagggcacagggtcctgggcccagtctgccctgactcagcctgactccgtgtctgggtctcctggacagtcgatcactatctcctgcactggccaccagcaggtnacagttaggtgtacttataactatgtctctagtaccaacaacacccagccacgccccagaccncatctatttctgatgtcagtgactcggtcctttaggggtactttctaatccgtcttcctctcgtcctactacgtcgtcggacaacgtacggtcccttccctacgaccctactccgtcccggctaccgacgtcgagacgcgagtctactatttattacgngctaagtctactaataactaccaaccggacgggtcctaacgttccgtccgtagtacgttacggttcgggaccgggtacggtaccggtcggtaccgtacgtacccgtaccggtacgtaccggaccgaaccccgg

SEQ ID NO: 366718 - DNA, 765 bp, Homo sapiens
  misc_feature: GZ8MTXP02HUJXO.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccaggccgtgggggtccctgagactctcctgtgcagcctgtgggtcagcatcagtaacgactacatcgaccgtcgggccccgccgaggccgtacccggaggggaacggggctaggggaggtggggtctcgtagttatagaaacagacgtggactactaactattacttattctcgtaactcggtaggtaaccggggtccgtacctaccctctaccaaggtactacctaacttacccaaaactaaaccctatttccggtttatactttaccctttaaccacgtaaacttcggacctaaaccttaaacgtaggtttacggaaacggtaacgggttaccccggaaaacggaaacccccgtaaccccgggggtaacccccttaaaaccttttaaacgtttttaacggtttccgggtaacccggacgtacccgggaaaaccttcgtttaaaaccggaacccgttaaaaccgttccggttaaacctttaacgggtttaacccggggtcccggggggtaaccccgtaaaacggggggtaaccccccggg

SEQ ID NO: 366719 - DNA, 616 bp, Homo sapiens
  misc_feature: GZ8MTXP02IISGE.10.38.D05.1.454.CMB.2.raw
  modified_base (558)..(558): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggactccgagccgtgggggtccctgacgactctcctgtgcagcctcgtggtcagcatcaagtaacgactacagtcgaccgtcggcccgccgacggcctaccggaggggaaggggcgtagggaggtgggtctacgtagtttaagtagaaaccgagtagtggacactacattatttattctcgaccgtccgtggaaacgggtcccgttacaccctcgtcgaagacgtacctacttacccaaaatacgtattacgttatacttccttacaactatcgacaactatcgagaacgtcgtacgaaccgtaacgccgtaccacgtttaattacgttcgggacnccgaacactacgtaacggaacccttacgcttaacgtacgtttccgggcggggaacccg

SEQ ID NO: 366720 - DNA, 678 bp, Homo sapiens
  misc_feature: GZ8MTXP02HG1IR.10.38.D05.1.454.CMB.2.raw
  modified_base (313)..(313): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgaggccgtgggggtccctggagactctcctgtgcagccttcgtgggttcagcatacgaagtaacgactacagtcgaccgtcgggccccncgacggcctaccggaggggaaggggcgtgggacggtggggttctacgtagtttaagttacggaaactaggaagtggacctaactaactaatttactttacttccgtagtaccgtaccggtacgggtaaccggggtccccggttacctaccccgtcgtaccgaagacgacctacccttaaccaaaacacctattcttacgtaacttccttaaccattaacgtcaaacctaactaattaccgtaagaacgggtaacgtaccggaacaaccgaacccggtacctaacctttaaaagttcgtttaggcgacgaccgaatacgtacgaactaaccgcttaactacggttccgcggggacccgaggacccg

SEQ ID NO: 366721 - DNA, 685 bp, Homo sapiens
  misc_feature: GZ8MTXP02H5FUG.10.38.D05.1.454.CMB.2.raw
  modified_base (305)..(305): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactgtggagactggaggaggctggatccaggccgtgggggtccctggagactctcctgtgcacgcctcgtggtcagcatcaagtaacgactacatcgaccgtcgggcccnccgaggcctacggaggggaagggcgtgggagtgggtctcgagttagttacgaaacagtacgtcggactacgtaactagtttaacttacttctacgtacttccggtaggtaaccggggtccccggtttaccaccccgttcgtaccgaaggtaccgaacctaaccttacccaaaacaaacttctttaccgttagttacttacccttacgaaacttacgtacgtaccctaaacgtaaacttccggtagaaacggtcgtacccggaacgaccccacgggtaccccttaaacgtttattacgttcggcgaaccggactaaacgacttcggaaacccttccgtactaacgttacgttccggggacggggaccctaagggggacccc

SEQ ID NO: 366722 - DNA, 620 bp, Homo sapiens
  misc_feature: GZ8MTXP02IMZNB.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctctgtgcagcctctgggttcagcatcaagtaacgactacatcgaccgtcgggccccgccgaggcctaccggaggggaaggggcgtgggaggttgggtctcgtagttattagaaacagactggcactactattattatctgtactcgtagaacgggtccgtcaccctctaccagacgacctacttacccaaaactaactattccttagtacttccttacaactatcgaccaactaactcgtagaacgacggtaccgaaccgtaaccgaccggtaccctaaacccgtttatttacgtttcggacgccggacgaactacgtcgaaaccttaaccggcttaacgtaacgtttcggacggggaccgaaggggaccccg

SEQ ID NO: 366723 - DNA, 581 bp, Homo sapiens
  misc_feature: GZ8MTXP02HPNDB.10.38.D05.1.454.CMB.2.raw
  modified_base (305)..(305): a, c, t, g, unknown or other
  modified_base (354)..(354): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagtcctcgtgggttcagcatcagtaacgactacatcgacctgggccccncaggctccgaggggaagggctggagtgggtctcgtagttattagaaacngactggacactacattattatctgactccgtagaacgggtccgtcaccctctaccagacgaacacttacccaaactactattccttagtactcttacgactattcgactaactaattccaggaacgtagtaccgaccgaaccgtaccgtacctaaccttattacgttgtacgcgtacgaccagtacgactaacgtcctacgtaacttcggtacgggcgagggacccg

SEQ ID NO: 366724 - DNA, 659 bp, Homo sapiens
  misc_feature: GZ8MTXP02JN6OF.10.38.D05.1.454.CMB.2.raw
  modified_base (365)..(365): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtggttcagcatcagtaacgactacatcgaccgtcgggccccgccgaggcctaccggaggggaacggggctggggaggttggggtctcgtagtttattagaaacngactggacactaacattattattctgtaccgtccgtagggaacggggtcccgtttaccaaccccttctacccgaagacgaacctacccttacccaaaacaaccctattccgttattacttccttaaccaccgtaattcggacctaactaaacttcgtaggaatacggtacccgaaacgacccgaacccggcctaaaccctttagttacgtttgcggaccgacggaactacgttaccggaacttaaccgactttacaaacggttttccggacgggggacccctaagggggccccg

SEQ ID NO: 366725 - DNA, 537 bp, Homo sapiens
  misc_feature: GZ8MTXP02FYGKT.10.38.D05.1.454.CMB.2.raw
  modified_base (304)..(304): a, c, t, g, unknown or other
  modified_base (353)..(353): a, c, t, g, unknown or other
  modified_base (423)..(423): a, c, t, g, unknown or other
  modified_base (451)..(451): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccaggccgtggggggtccctgagactctcctgtgcagcctcgtgggttcagcatcagtaacgactacatgacctgggcccnccaggctccgaggggaaggggctggagtgggtctcgagttatagaaacngatggcactacatattatctgactcgtagaacgggccgttcaccctctccagacgacacttccaaacacntcttgtactcttcacatcgcaacaatcngagagtcgaacgacacgcctaactattattgcgcgcgactatcgaactaaccgctactaacgttcgacggggacccaggggacccg

SEQ ID NO: 366726 - DNA, 572 bp, Homo sapiens
  misc_feature: GZ8MTXP02FNY77.10.38.D05.1.454.CMB.2.raw
  modified_base (356)..(356): a, c, t, g, unknown or other
  modified_base (435)..(435): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctcgtgggttcagcatcagtaacgactacatcgaccgtgggccccgcagggctccgaggggaaggggctgggagtggggtctcgtagttattgaaacngatggacactacatattattctgactcgtagaacgggtcgttcaccctctccagacacacttccaaaacactaatcttntactcttacactatcgacaacaatctacgagtacgtcgaacgactaccgggaccctaaccgttattattcggtacgccgtacgaactactcggaaactaaccgctacaaagtttccgacgggggcctaggggacccg

SEQ ID NO: 366727 - DNA, 617 bp, Homo sapiens
  misc_feature: GZ8MTXP02HEJUX.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggctggatccgagccgtgggggtccctgacgactctcctgtgcagcctgtggtcagcatcagtaacgactacatcgaccgtcgggccccgccgaaggccgtaccggaaggggaacggggcgtagggaggtcggggtctacgtagttagttaacgaaactaggatacggactactaactaattatttattctacgacgttaccggtagggtaaccgggtcccgtacctacccgttcaccgaggacaacctacctacccaaaacacctaattccgttataacttccttaacgacctatacaccaaatatcgtagagacgtacgaacgaccgtacgccttaactaagtcttgacgcgaccgatagctaccgaacgctacgagttcggacggtaccaacgggccg

SEQ ID NO: 366728 - DNA, 614 bp, Homo sapiens
  misc_feature: GZ8MTXP02JFRYC.10.38.D05.1.454.CMB.2.raw
  modified_base (506)..(506): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtgggggtcctgagactctcctgtgcagcctctgggttcagcatcagtaacgactacatcgacctcgggccccgccaggcctccgaggggaacggggcgtgggaggtcggggtctacgacgtttagttaggaaaactagacgtggacactaacagttactttattcgtcgtacgttcccggtaggaaaccgggggtccggtttaccaccccgtcctccaacgtacgaacctacccttaacccaaacaactattcttagtacttcttacactatgacanaactctagacgagtacgaacggtaccaccggacctaaccgttactagtttagcggacgacgacactcgaacttaaccgctacaacgttccgacgggaccgaggacccg

SEQ ID NO: 366729 - DNA, 571 bp, Homo sapiens
  misc_feature: GZ8MTXP02JYE1A.10.38.D05.1.454.CMB.2.raw
  modified_base (438)..(438): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtggttcagcatcagtaacgactacatcgaccgtgggccccgccaggcctaccgaggggaaggggcgtgggaggtgggtctcgtagttatagaaacagatggacactacatattattctgactccgtagaacgggtcccgttacactctcgtaccagacaccaccttacaaactaanactcttagtactcttacacgtatgacactaatctagagtacgtccgacgacctacggccctaacttattatggtacgcggtaccaacagtcgaacctacgtacctactaacgttcggacgggggacacggggg

SEQ ID NO: 366730 - DNA, 637 bp, Homo sapiens
  misc_feature: GZ8MTXP02G8FNU.10.38.D05.1.454.CMB.2.raw
  modified_base (496)..(496): a, c, t, g, unknown or other
  modified_base (501)..(501): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaaggtgtccactgtgaggttcaactggtggagacgtggaggaggctggatccagccgtgggggtccctgagactctcctgtgcagcctcgtggtcagcatcaagtaacgactacatcggaccgtcggggccccgccgacggccgtaccggaaggggaacggggcgtaggggaggttcggggtacttacgtaagtttaagttaaggaaaacgagacgtcggacctaactaactagtttaattattcgtacgtaccgttccggtaggtaaccggggtccggttcccaccccgttcaccgaagaaccgacctacctaacccaaanacctnttcctatacttctacatagcacacatcagatacggtacgacgacgaccgccctaactttaattcgttgccgacgactaacgacttcgaacctaacgtcttaacgtacgtttcgggaccgggaccgacgggtacccg

SEQ ID NO: 366731 - DNA, 614 bp, Homo sapiens
  misc_feature: GZ8MTXP02I9QEP.10.38.D05.1.454.CMB.2.raw
  modified_base (484)..(484): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcaagtaaccgactacagtgaccgtcgggccccgccagggcctccggaaggggaacggggctgggaggtggggtctcgtagtttagtagaaaacagacgtggacaactaacattaatttattccgtgtaaccgttccggtagggaacggggtcccggttaccaacccctctacccaaggtacaacctacttacccaaacactaattcgttntactcttacacgtatcacactaattccagacgtacgtacgaacgaccgtacgacccaacgtttattacgttgcgccgacaactacgtcgaacctaacgtctactaacgtcggtacgggcccgaggacccg

SEQ ID NO: 366732 - DNA, 534 bp, Homo sapiens
  misc_feature: GZ8MTXP02FYJX5.10.38.D05.1.454.CMB.2.raw
  modified_base (270)..(270): a, c, t, g, unknown or other
  modified_base (333)..(333): a, c, t, g, unknown or other
  modified_base (363)..(363): a, c, t, g, unknown or other
  modified_base (432)..(432): a, c, t, g, unknown or other
tcagcatagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaaccagcagtgtacttttgtgcttaataactatgtctcctggtaccanccaccaccaggacaaacgcccctaaactccttgtttgagtcagtacgcgcctgagcgtcctgntcgtctctcgcctcaagtcgtagcctaacnccggcctcctgtaccgtctcgtggctccgagtctggagtctggagctagtatttacgactgacagcacntaactcgacgaccccagtcgggtgttcggcggacgacgtaggtcgtccgtcgtcggcacgtccgaggcttccgcccgtgactcctcttccgtcccacctccc

SEQ ID NO: 366733 - DNA, 706 bp, Homo sapiens
  misc_feature: GZ8MTXP02IYCMJ.10.38.D05.1.454.CMB.2.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagtcttgggttttccttgttgcttatttacaaaaggtgtccactgtgaggttcaactggtggagacgtggaggaggcgtggatccagccgtcgggggtcctgagctctcctgtgcacgcctcgtggtcagcatacaagtaacgactacacgtcggacccgtccggggccccgccgacgggccgtacccggaagggggaacggggtcgtaggggtacggttcggggttctaccgtaaggtttaacgttaggaaaacgtagtacgtacggacctaacgtaactaatttacgtttacttcgtacgtacccttcggtacgggtaaccggggttcccgttactaccccttcgactaggacgaaccctaccttacccaaaactactacgttctttacgtacttacctttacacgttatacgacctaaactatccgagtacgaacgtccgaaaccgccgaacccggtaccttaccgtttaaatttcggttacgcggaccgaccgtactacgtacgaacctaacgtcttaacggtacgttccggaccggggaccgaacggggtaccccg

SEQ ID NO: 366734 - DNA, 561 bp, Homo sapiens
  misc_feature: GZ8MTXP02HWUO8.10.38.D05.1.454.CMB.2.raw
  modified_base (404)..(404): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactgggaggaggctggatccagccgtgggggtccctgagactctcctgtgcagcctgtgggttcagcatcagtaacgactacatcgacctgggccccgcaggctaccgaggggaagggctgggagtgggtctcagttatagaaacagatgacactactattattatctagactcggtagaaggggtcccgtactaccctnaccagacacacttaccaaacactattctagtactcttacacgtatacgtacaactaatcgtagacgtacgtacgacgacaccggtccaactttatagttcgcgacgacgtacatcgaactaacgctacgtaagttccggacggggaccaaggggccc

SEQ ID NO: 366735 - DNA, 678 bp, Homo sapiens
  misc_feature: GZ8MTXP02HU1UW.10.38.D05.1.454.CMB.2.raw
  modified_base (304)..(304): a, c, t, g, unknown or other
  modified_base (357)..(357): a, c, t, g, unknown or other
  modified_base (384)..(384): a, c, t, g, unknown or other
  modified_base (420)..(420): a, c, t, g, unknown or other
  modified_base (461)..(461): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagccctcgtgggttcagcatcaagtaacgactacatcgacctgggccccnccgagggctccggaaggggaggggctgggagtgggtctcgagttatagaaacngtacgtggacacgtacattattattcngtacctccggtgaaggggtcccggttcacccccgtntacccgaagaccgtaaccaccttacccaaaacgaaaccttnttcttacgttacttcttaccgaaatacgtagtaccaaatacgtacgtagggaacgtaccggtaccggaaccgaaccgtaccggtacccttaaaccgttacgttttacgtttcggacgtaccggtaaccgtaacgtaccgtacggaaccgtttaaccgtaccgttaaccgttaaccgggttcccggggacgggggtacccggtaaccgggggaccccg

SEQ ID NO: 366736 - DNA, 931 bp, Homo sapiens
  misc_feature: GZ8MTXP02FKQZ1.10.38.D05.1.454.CMB.2.raw
  modified_base (272)..(272): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctggagtgggtctcagttattagaaacagatggcactacattattatctgactcgtggaacgggccgttccaccctcnccagacgacaccttaccaacaacatcctttgtattccttcaactatcgacaacaaattcctagggacggacggtaccggaaccgaaccaacccggggtaccctaaaccccctttagtttaacgtttcgtacggacccggaccggtaactacgtacgggaaaccttaacccggcctttaaacccgtaaacgttttccggggttaccgggggggaccccgaaaggggggtacccccgtaacccccggggtaaacgggtccccgttaaaccccccggggttccccttaccccccccggtaaaccggtccccccgttaacccccgaaaacccccgggtaaaaccccggggggtccccccttaacccgggtttcccccggggtttacccccccgtttaccccccccgggtccgggggtccccccgggttcccccgttaccggtacccccttacccggggtaacgggacccgtacccccgtaaaaccccggggtccccgggaacgggtaaccccggacccgaaaccgggtaacccggggcccccggggtcccccggggtttcgggggccccgttcggggtacccccgttcggggttaaaacccgaaacccgggggttaacctttacccccgtttacccccggtaaactttaccccgtttaaacgg

SEQ ID NO: 366737 - DNA, 654 bp, Homo sapiens
  misc_feature: GZ8MTXP02GGZ8F.10.38.D05.1.454.CMB.2.raw
  modified_base (562)..(562): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggactccagccgtgggggtccctggagactctcctgtgcagcctgtgggtcagcatcagtaacgactacatcgaccgtcgggccccgacacgggcctacccggaggggaacggggtctgggaggtcgggtctacgtagttataggaaaaccagagtcggaccaactaactattaatttacttcgacgtacccgttaccggtacggggtaaaccggggttcccggtttaccaaccccgttcgaacccgaaggactaacctaacccttaacccaaaacgaactacgttcgttaatactcctttacaacctatcgactaacgtaattccgagacggactcggaaacncgacgacctacgttattacgttgacggcgacctacgtaagcgtaaacccgtcgaccctataaacggttcggacgggaccgacggggtacccg

SEQ ID NO: 366738 - DNA, 603 bp, Homo sapiens
  misc_feature: GZ8MTXP02FOVL9.10.38.D05.1.454.CMB.2.raw
  modified_base (370)..(370): a, c, t, g, unknown or other
  modified_base (394)..(394): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcacgtcctcgtgggttcagcatcagtaacgactacatgaccgtcgggccccgccgaggcctccggaaggggaacggggcgtggggagttggggtcctgtagttatagaaaacngatggcaactacaattattattcngtaccgtccggagtaaccggggtccgtttccaccctctaccaggacaacctaccttacccaaacaactattcttacgtaactccttacactatcgacaactaatctagagacgtcgaaccacgaccgacctaacctatttactggtacgcgcgaacgtactagaaccgtaacgtcctaactaacgttcggacgggccggaagggacccg

SEQ ID NO: 366739 - DNA, 654 bp, Homo sapiens
  misc_feature: GZ8MTXP02JKN3S.10.38.D05.1.454.CMB.2.raw
  modified_base (437)..(437): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctctgggttcagcatcagtaacgactacatcgaccgtggccccgcacgggcctccgaggggaaggggcgtgggaggttgggtctcgagtttattaggaaacagacgtcggacactacattatttattctagacgtccgtagaacgggtccggttaccaccctctaccgagacgaaccnccttaccaaacaacctagttcttagtactccttacactactcgacctaactaacttcgtacgacgggtaacggtaccgaaccgtaaccggacccggtacccctaaaccgttatttaacgttcgggtcgaccgggacgtaacacgtttacccgaaacttaacccggactttaacgaaaccgtttccggtacgggggtaacccctaacgggggaccccg

SEQ ID NO: 366740 - DNA, 613 bp, Homo sapiens
  misc_feature: GZ8MTXP02IZ7YL.10.38.D05.1.454.CMB.2.raw
  modified_base (362)..(362): a, c, t, g, unknown or other
  modified_base (453)..(453): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggtttttccttgttgctattttcaaaaggtgtccactgtgaggttcaactggtggagactggaggaggctggatccagccgtgggggtccctgagactctcctgtgcagcctcgtgggttcagcatcagtaacgactacatgacctcgggccccgcagggcctaccgaggggaacggggcgtgggaggtggggtctcgagttattagaaacngatcgacactaacattaacttattctacgacttccggtaggaacgggtccggtcaccctctccagacacacttacccaaacactactcttntaactcttacacgtatcgactacaaattctagaacgacgtaccggaacgtaccgaaccggaccctaccttaactttagtcggtacgcccgtaacggacctagtcgtaaaaccgtcgaccttaacgtaaacttcggtaccgggggaccaagggggaccccg

SEQ ID NO: 366741 - DNA, 641 bp, Homo sapiens
  misc_feature: GZ8MTXP02G52IM.10.38.D05.1.454.CMB.2.raw
  modified_base (466)..(466): a, c, t, g, unknown or other
  modified_base (471)..(471): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctcgggccccgccgaggcctccggaggggaaggggcgtgggaggtgggtctcgagttatagaaacagatgcactacatattattctgtactccggtagaacggggtccggttccaccctcctacagacgacctaccttacccaaacaactattccttagtactcttacacatnaccanaatctagagtacgtaccgaacgacctaccggaccctaaaccgttacgtttaattcggtacgaccggacgtaacctaacgttccgggtaaaacccttaaccgggtaaccttaccgttaaaacggtttcccggtaccggggggtaccccggtaaaacggggggtaacccccg

SEQ ID NO: 366742 - DNA, 586 bp, Homo sapiens
  misc_feature: GZ8MTXP02I9LJ8.10.38.D05.1.454.CMB.2.raw
  modified_base (256)..(256): a, c, t, g, unknown or other
  modified_base (303)..(303): a, c, t, g, unknown or other
  modified_base (357)..(357): a, c, t, g, unknown or other
  modified_base (411)..(411): a, c, t, g, unknown or other
  modified_base (454)..(454): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcngcctcgtgggtcagcatcagtaacgactacatgaccgtcgggccccnccgaggcctccggaggggaggggcgtgggagtgggtctcgtagttatagaaacngatggcactacattattattctgtacgttccgtaggaacggggtcccgttaccnccctctccgagacgacctaccttacccaaactactattcttanactccttacactatcgacactaatcgtagagacgtccgaacgaccaccggaccctaacttattagttggtcgaccgtacgactatcgactaacgtcttactacggtttcggacggggacccaggggtacccg

SEQ ID NO: 366743 - DNA, 609 bp, Homo sapiens
  misc_feature: GZ8MTXP02F7RKU.10.38.D05.1.454.CMB.2.raw
  modified_base (363)..(363): a, c, t, g, unknown or other
  modified_base (487)..(487): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcacgcctcgtggtcagcatacagtaacgactacatcgaccgtcgggaccccgccgaggtccaccggaggggaagggcgtgggaggtgggtctacgtagttatagaaacngacgtcgacactactattacttattcgtacgtacgttccggtaggaaccgggtcccgttaccacccttcaccgaagactacctaccttaacccaaacactcgttacttatactcttacaacgtntacactactactgagacgacgacgaacgaccgacgtacctaacgttattacgtcgacgacgtacgtactacgtacgtacctcgtacgttacgttacggtcgggacgggaccgacgggacccg

SEQ ID NO: 366744 - DNA, 615 bp, Homo sapiens
  misc_feature: GZ8MTXP02JQZMY.10.38.D05.1.454.CMB.2.raw
  modified_base (359)..(359): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcagtaacgactacatcgaccgtcggccccgcgacggccgtccgaggggaaggggcgtgggaggtgggtctcgtagttatagaaacngactggcactacattacttattcgtgtacgtccggtaggaacggggtcccgtttaccaccccgttctaccgaagacgacctactaacccaaacaactattcttagtacttacttaccacgtatcgtacaacctaagtcgtaggacgtacggtaccgaacggaccaccggacctacgttaattagtcggacgcgtacgtacagtacgtaacctaacgtccctaagtacgttccggacggggacccgaaggggtaccc

SEQ ID NO: 366745 - DNA, 603 bp, Homo sapiens
  misc_feature: GZ8MTXP02IU5K7.10.38.D05.1.454.CMB.2.raw
  modified_base (363)..(363): a, c, t, g, unknown or other
  modified_base (388)..(388): a, c, t, g, unknown or other
  modified_base (447)..(447): a, c, t, g, unknown or other
  modified_base (500)..(500): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtcctgagactctcctgtgcagcctctggttcagcatcagtaacgactacatcgacctcgggcccgccagggcctaccggaaggggaaggggcgtgggaggtcgggtctacgtagtttatagaaaacngaatggactactacattattattcncgtaactccgtagaacgggtccgtcaccctctacgagacactaccttaccaaactaacncttactgtactctttacactatcgacactaaatctagagtacgtcgaacgacnccgacctaaccgttatttagtcgtacgaccgtcgtaacattacggaaccttaaccggacttacggtaacgtttccgggacgggggacccgaagggggaccccg

SEQ ID NO: 366746 - DNA, 827 bp, Homo sapiens
  misc_feature: GZ8MTXP02IHJXR.10.38.D05.1.454.CMB.2.raw
  modified_base (378)..(378): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtgggaggaggctggatccgaggccggtcgggggtccctagagactctccgtgtcgcacgcctcgtgggtcagcatacaagtaacgactacagtcgaccgtcgggccccgccgaggcctaccgaggggaacggggcgtagggagttgggtctcgtagttatagaaacngactggacacgtacagttattattcgtagtaccgtccggtagggtaaaccggggtcccggttacctacccccgtacgttacccgaaacggtaccgtaaccctaaccctttaaacccgaaaacctaaaaccttacgttttaccttttacgtaacctttacctttaaccctaaaccgttaattacccggtaacctaaaacccttaacgtttacccgttaaggggaaaaccggttaccggttaaaccccgggaacccgggaaacccccggtaacccggggtaaaccccttaaaaccccgtttttaaagttttaaacggtttccggggttaacgaccccgggtaaacggtacccttaaaagttccggaaaacccggttaaccgtacctttaacggtaaaacccggttttcggaaccccggggggtaaccgttaaccgggggaaaccccccggg

SEQ ID NO: 366747 - DNA, 602 bp, Homo sapiens
  misc_feature: GZ8MTXP02FY2NY.10.38.D05.1.454.CMB.2.raw
  modified_base (369)..(369): a, c, t, g, unknown or other
  modified_base (428)..(428): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtgggaggaggctggatccgagccgtggggggtccctgagactctcctgtgcagcctgtgggttcagcatcagtaacgactacatcgaccgtgggccccgcagggcctaccggaaggggaacggggcgtgggaggtggggtctcgtagtttagtagaaaacngacgtggcaactacattattattctgacctccggtagaacggggtcccgttcacccctntccgagacgtacaccttacccaaacactattcttagtactcttacactatcgacactaatctagagtacgtacgacgaccacgaccctaacgttattacgttgtcgacgtacgaactacgtacgaactaaccggtactacgtacgtttccggacggggacccgagggggacccc

SEQ ID NO: 366748 - DNA, 591 bp, Homo sapiens
  misc_feature: GZ8MTXP02IAA1Y.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcatcaagtaacgactacatgacctcgggcccgccaggctccgaggggagggctgggagtgggtctcagttatagaaacagatggcactacattattattctgactccggtgaacgggtcccgttacaccctctaccagacgacctacttacccaaaacaacctattcttagtactccttacactagtcacaacaatctagaagacgtcgaaccgaccgaccggaccctaacccttattacgtttggtcaccggacgaaccattcggaacttaacccggcttaacctaaagtttccggacgggggcccaaagggggcccg

SEQ ID NO: 366749 - DNA, 582 bp, Homo sapiens
  misc_feature: GZ8MTXP02JVEML.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgaccgtcgggccccgccgaggctccgaggggaaggggctgggagtgggtctcagttatagaaacagatggcactacatattattctgactccgtgaacgggtccgtacaccctctaccagacgactacttaccaacactatcttgtatcttacactatcgacacatctagagtacgtacgacgacgtaccggaccctaaccttagttacgttggtacgtaccgacgtacacgttacgaaccgtaacgtaccttaccgtaaagtttcccggacgggggacccgaaggggaccccgg

SEQ ID NO: 366750 - DNA, 594 bp, Homo sapiens
  misc_feature: GZ8MTXP02HSHPL.10.38.D05.1.454.CMB.2.raw
  modified_base (359)..(359): a, c, t, g, unknown or other
  modified_base (478)..(478): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctctgtgcagcctgtgggttcagcatcaagtaacgactacatcgacctgggccccgccaggcctccgaggggaagggctgggaggtggggtctcgtagttagttagaaaacngtactggactactacattattattctagactccgtggaaggggtcccgttacaccccgtctacccaggacacctaccttacccaaaacaacctattcttagtacttcttaccaatagtnacaactaatccaggaacacgtacggaacaaccgacgaccctaacctttattaattggtcgcgtaacgacctatacgactaacgtctaccgtaagttcggcgggacggtaggacccg

SEQ ID NO: 366751 - DNA, 638 bp, Homo sapiens
  misc_feature: GZ8MTXP02FLGQR.10.38.D05.1.454.CMB.2.raw
  modified_base (324)..(324): a, c, t, g, unknown or other
  modified_base (452)..(452): a, c, t, g, unknown or other
  modified_base (458)..(458): a, c, t, g, unknown or other
  modified_base (495)..(495): a, c, t, g, unknown or other
  modified_base (505)..(505): a, c, t, g, unknown or other
  modified_base (535)..(535): a, c, t, g, unknown or other
  modified_base (568)..(568): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtgggagggaggctggactccgacggccggtggggggtccctggacgaccttcctcctgtcgcacgcctcgtggtcagcatcgaagtaacgactacatcgaccgtcgggccccncgaggcctaccggaaggggacgggcgtgggaggtgggtctacgtagtttaataggaaacagacgtggacctaactactattactttaattctcgtacgtccgggttaggaacggggtcccgttaaccncccgtntaccgagacacctacctaccaaacacgtattccttanaccttctacnctagtacacactaatcgtagagttaaccgngaaccgaccaccgtaccctaaagtttatttcgnggtccgcgacgtaaactcgttacgacctaacgcgttaactacggttcggggccgggaacgacgggacccg

SEQ ID NO: 366752 - DNA, 633 bp, Homo sapiens
  misc_feature: GZ8MTXP02ISGJ5.10.38.D05.1.454.CMB.2.raw
  modified_base (359)..(359): a, c, t, g, unknown or other
  modified_base (429)..(429): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtggtcagcatcaagtaacgactacatcgaccgtcggccccgcaggcctaccggaggggaaggggcgtggaggttgggtctgtagtttatagaaaacngacgtcggactactactaattatttatcgtagtacctccggtaggaaccggggtccgttaccacccttcncgaagacgaacctaccttaacccaaactactattccttagtactcctttacaactatacgactaactactcgtagaacgacgtaccgaaacgacctaccggaccttaacctttaagttacgtttcgggacgaccggtacgaaccgtattaccggaaccttaacgtcctacgtaacgttccgggacggggcccgaaagggtcccg

SEQ ID NO: 366753 - DNA, 587 bp, Homo sapiens
  misc_feature: GZ8MTXP02FIN4X.10.38.D05.1.454.CMB.2.raw
  modified_base (343)..(343): a, c, t, g, unknown or other
  modified_base (415)..(415): a, c, t, g, unknown or other
  modified_base (443)..(443): a, c, t, g, unknown or other
  modified_base (456)..(456): a, c, t, g, unknown or other
tcagcatagtagtgcacgaccggtgctcgatttagtatctgataggttggggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctgggatccagccgtggggggtcccctgacgactctcctgtgcagcctctggggttcagcatcagtaacgactacatgacctaggccccgccaggcctccgaggggaaggggctgggagtgggtcnctagttatgaaactagactcggcacttacattacttattctagactccggtgaacgggtccgttcaccctcnccagagacacttccaaacaacatcgttnatcttacacagtnacacaaagtctagagagtaccgacggaccacggacccaaccgtatttacgtcggttcgcggtacgaacacgtacggaaccttaacggccttaaccaaacggtttccgcgggggacccaagggggaccccgg

SEQ ID NO: 366754 - DNA, 657 bp, Homo sapiens
  misc_feature: GZ8MTXP02IP4JM.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtgggggtccctgacgactctcctgtgcagcctcgtgggttcagcatcaagtaacactacatcgaccgtcgggccccgccgagggccgtccggaaggggaacggggcgtggggacggttggggtctacgtaagtttagttagaaaacgtagaagtcggacctaacgtaactaatttaactttactttcgtcgtaaccgttcccggtagggtaaccgggggttcccggttacccaccccgttctacccgaggaacgtaccgtccttaaccaaacaacctattcttagtactcttaccactatcgacaactatcgtagacgtacgtacgaacaccgaaccgtcctaacttaagtttgtcggtcgacgacgactaaacgtcgaaacctaacgtctaactaacgttccggacggggaccgagggtaccccg

SEQ ID NO: 366755 - DNA, 727 bp, Homo sapiens
  misc_feature: GZ8MTXP02HEATP.10.38.D05.1.454.CMB.2.raw
  modified_base (260)..(260): a, c, t, g, unknown or other
  modified_base (307)..(307): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggctggatccaggccgtgggggtcctgagactctcctgtgcngcctcgtggtcagcatcagtaacgactacatcgaccgtcgggccccnccgaggcctaccggaaggggaacggggcgtaggggaggttcgggtctacgtaggtttaagtacgaaaacgtagagtcggactaactaacattaatttattcgttacgaaccgttaccgggtacggaaaccgggggtcccgttaccctaacccccgtcgtacccgaaggtaacgtaaccctaaccctttaacccaaaacctaactactttacgtttactacttcctttaacaccttagttacaactaacctaaattccgtaagtacggaaccgttacggaaacccgtaccgaaacccgggtaccctaaaccgtttaactttaaggttcgttaccggaccgaccgtaaccgtaataccggtaacctaaccggtcttaacgtaaacggtcggttaaccgggggccctaacgggggaaccccgg

SEQ ID NO: 366756 - DNA, 703 bp, Homo sapiens
  misc_feature: GZ8MTXP02JR1H0.10.38.D05.1.454.CMB.2.raw
  modified_base (663)..(663): a, c, t, g, unknown or other
  modified_base (669)..(669): a, c, t, g, unknown or other
  modified_base (676)..(676): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagacctctcgtgtcgcgccgtcctcggttcggtacgcgactactacgtaacgtaacgtaacctaactacgtaccgtaccggcccgggccccgaccggacggtcccgtaccggggaacgggggaacggggtcggtagggtacggggttcgggttctacggtttaaggtttagttaaacggaaacgtaggtaccggtcgaacctaactaactaatttaactttacgttcgtcgtaccgttccgggtaaggggtaccgggttcccggtacccctacccgtcctaaacgaggtaaccaaccctacctaaaccaaacctatacttcttaatcttaccgttacaattacgcaaccaaactaggttcgaaggtacgacggtacccgacgtaaaccgccgtaaccctattacttgtcgcgccgactacncgtacncaaccgntaagtccgtggaccggacgaggacccc

SEQ ID NO: 366757 - DNA, 590 bp, Homo sapiens
  misc_feature: GZ8MTXP02HKDKA.10.38.D05.1.454.CMB.2.raw
  modified_base (257)..(257): a, c, t, g, unknown or other
  modified_base (362)..(362): a, c, t, g, unknown or other
  modified_base (462)..(462): a, c, t, g, unknown or other
  modified_base (518)..(518): a, c, t, g, unknown or other
  modified_base (540)..(540): a, c, t, g, unknown or other
  modified_base (564)..(564): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagacgtgggaggaggctggatccagccgtgggggtccctgagactctcctgtgcngcctgtgggtcagcatcaagtaacgactacatcgaccgtcgggccccgccaggcctccggaggggaaggggcgtgggaggtgggtctcgtagttattagaaaacngacgtggacactacattattattcgtgtaccgtccgtaggaacggggtcccgttaccacccctctacccgaagacgacctaacttacccaaaactaactnttaccttagtactcctttacaacgtattcgacaactatctgaagcgtacgacgacnccgaccacttattacgttgcgngacgacactcgaacttaacgctanaacgttcggacgggcgaacgggtccc

SEQ ID NO: 366758 - DNA, 693 bp, Homo sapiens
  misc_feature: GZ8MTXP02GQ172.10.38.D05.1.454.CMB.2.raw
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctgtgggttcagcatcagtaacgactacatcgaccgtcgggcccgccaggcctaccgaaggggaagggcgtgggaggtcgggtctacgtaagttagttagaaacccgagacgtaggacctaaccgtaactattagtttacttcgtaggtacccgttacccggtagggaaaccgggggtcccgtttaccaccccgttcacccgaaggtacaaccctactacccaaactaactatttcgttagtaacttccttaacacttagaccgacctaaactaacgttcgtaggaaacggtacggttacccgacgaaaccgaccccggtaacccttaccgtttagtttaacgttcggacgggacccgaccggtaactaggttaaccgtaaccgttaaacggccttaaacggtaaaccttttccgggggacgggggaacccg

SEQ ID NO: 366759 - DNA, 597 bp, Homo sapiens
  misc_feature: GZ8MTXP02I5JY1.10.38.D05.1.454.CMB.2.raw
  modified_base (369)..(369): a, c, t, g, unknown or other
  modified_base (420)..(420): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtcctgagactctcctgtgcagcctcgtgggttcagcatacaagtaacgactacatcgaccgtccgggccccgcgacggccgtaccggaaggggacggggcgtgggaggttgggtctcgtagttagtagaaacgngacgtgcactactattattatctcgactcgtagacgggtccgtccaccctntaccgagacactacctacaactacattctatacttcctacatactacgtaccaacctaagtccgtaagacggacgtacgaccgacgacccggaccttaaccttagtattcggcgtccgacgactacgcgtaactaaccgtactacgtaacgtcccgggtagggacccgagggacccg

SEQ ID NO: 366760 - DNA, 719 bp, Homo sapiens
  misc_feature: GZ8MTXP02IDD2M.10.38.D05.1.454.CMB.2.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggagggaggctggatccgagccgtcgggggtccctgacgactctcctgtgcacgcctcgtggttcagcatcaagtaacgactacatcgaccgtcgggccccgccgacggccgtaccggaagggggaacggggtcgtaggggacggttcggggtccttacgaaggtttaacgtaggaaaacgaggtaccgtacgggtacctaacgtaaactaatttaaactttacgttccgttacggtaacccgtttacccggggtacggtaaacccggggggttccccggtttaaccctacccccgttactacccgaaacggtaacgtaaccctaacccttaaccccaaaactaacctatttaccttagtaactcttaaccaacgtatcgaccaacgtaactctaggaagtacggacaaccggaccaccggtaccctaacttattagtcgtcgaccgacataacttcgaacctaacgacctacgtaaacgttccggacggggaccaacgggggaacccc

SEQ ID NO: 366761 - DNA, 628 bp, Homo sapiens
  misc_feature: GZ8MTXP02IZDDR.10.38.D05.1.454.CMB.2.raw
  modified_base (364)..(364): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtcctgagactctcctgtgcagcctcgtgggttcagcatacaagtaacgactacatcgaccgtcgggccccgccacggcctaccggaggggaacggggctgggaggtgggtctcgtagttatagaaacngatgacaactactaattattaattcgtacgtacgttccggtaggtaaccggggtcccgttaccaccccttcgaccagaacgacctaaccttaccaaacactatcctttagacttcttaccaactatacgactaactaactcgtaagacgtaacgtaccgaacgtacgaccgtcctaacgtttatacgtttggacgtcgacgtactacgtacgtaacgttaaccgtctacgtaacgttccggaccggggacgtacgggggacccc

SEQ ID NO: 366762 - DNA, 633 bp, Homo sapiens
  misc_feature: GZ8MTXP02H2CF8.10.38.D05.1.454.CMB.2.raw
tcagcatagtagtgcacgaccggtgctcgatttagtatctgatagttgggtttgggggggacaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggtcagcatcaagtaacgactacatcgacccgtcggggccccgccgaagggccctaccggaaggggaaggggcgtgggaggtggggtctacgagttaattagaaacagagtggacactacattattactctagtactccggtagaacgggtcccggtaccacccctctacccagaacgacctaccttacccaaactaacattctacgttactcctacacgtatcgacactaatcgtaaggagcgtaccgacgaaccgaccggaccctaaactttattacgttgacgacgtaccgaaactacgtacggaaacctaaccggtcctaacgttaaacggttccggacgggggacccctaaagggggacccccg

SEQ ID NO: 366763 - DNA, 649 bp, Homo sapiens
  misc_feature: GZ8MTXP02GWUUA.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgacgactctcctgtgcagcctcgtgggttcagcatcaagtaacgactacatcgaccgtcggccccgccgaggccgtaccgaggggagggcgtgggaggtcgggtctacgtagttagtagaaacagacgtgacaactactattattacttctgtacgtccggtagggtaacggggtcccggtttacccacccccttcgtacccgaacgaacgtaccctacccttaacccaaaactaacctgttaccttagtacttcttacaactgtcaccaactagtactacgaagacggtcgaaccgaccgaccgacccttaacgttattacgttgaccggaccgtacgtaacacgtaccgtaactaacggtccttaacggtaacgtcgggtaccgggggaccgtaacggggaccccg

SEQ ID NO: 366764 - DNA, 651 bp, Homo sapiens
  misc_feature: GZ8MTXP02ISCKZ.10.38.D05.1.454.CMB.2.raw
  modified_base (304)..(304): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggacccaccatggagttttggctgagctgggttttccttgttgctatttcaaaaggtgtccactgtgaggttcaactggtggagactgggaggaggctggatccagccgtggggggtccctgagactctcctgtgcagcctctggttcagcatcaagtaacgactacatgacctcgggccccncgacggctcccgaggggaacggggcgtggaggtgggtctcgagtttagtagaaacaggatcggactactactattaatttaacttctcggtacgtccggtaggaacggggtcccggttccaaccccgttctacccgaaggactaaccaccgttaacccaaactaactacttcgtttactaatcctttacaacggtaacttcaactaactaattccgagacgtaaggccgaaacgccgaaccggaccctacctaaatttattcgggagtccgacggaacacgttacggtaactacccggtcttaaccgacggttcgggaccgggggaccgtacggggtaccgtcccgg

SEQ ID NO: 366765 - DNA, 593 bp, Homo sapiens
  misc_feature: GZ8MTXP02FJ3PC.10.38.D05.1.454.CMB.2.raw
  modified_base (359)..(359): a, c, t, g, unknown or other
  modified_base (413)..(413): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgacacatcgaccgtcgggccccgccagggcctccgaggggaaggggctgggagtggggtctctagtttactagaaacngactggcaactacatattattctgactcgtagaacgggtccgttaccacccgtntaccgaagacgacctaaccttcccaaaactacctattccgtttacgtattccttacaaccattcgacaactaagtcttaggatacgtccgaacgtacacccggtcctaacctattacgttgcgccgacgactagtcgacctaacgctacgaacgtttcgcggggacctagggggaacccg

SEQ ID NO: 366766 - DNA, 571 bp, Homo sapiens
  misc_feature: GZ8MTXP02HA9UY.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctgggatccagccgtgggggggtccctgagactctcctgtgcagcctctgggttcagcatcagtaacgactacatgacctggccccgccaggctccgaggggaaggggctggagtgggtctcagttatgaaacagatggcactacatattatctgactccgtgaacgggtccggttcacccctctccagacgacacttacccaactaacattcctgtatcttacactatcgtcaacaatctagagtacgtacgaacggacctaccgggacctaacccgttaattagttcggtgtcgacggactactggaaccctaacgtctacctacgttacggtcggggacccgagggacccgg

SEQ ID NO: 366767 - DNA, 654 bp, Homo sapiens
  misc_feature: GZ8MTXP02JU2SD.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtcctgagactctcctgtgcagcctctgggtcagcatcaagtaacgactacatcgaccgtcggccccgccgaggcctaccggaggggaacggggcgtgggaggtgggtctacgtagttagttagaaactagacgtaggactactacgtattacgttattctagactccggtagacggggtccgttccacccttctaccagacgtaccactacccaacaactacttcttagtacttctacactatcgacctaactacttacgtaggaaacgtacggttaccgaaccggaaacccgtaccggtaccctaaccctttaagtttacggttcggttacggccgaccgtacgtaactacgtaaaccgtccgtacccgttacgttaaaccgttccgggtaccggggtaccgtacggggaaccccgg

SEQ ID NO: 366768 - DNA, 543 bp, Homo sapiens
  misc_feature: GZ8MTXP02JYI5H.10.38.D05.1.454.CMB.2.raw
  modified_base (371)..(371): a, c, t, g, unknown or other
  modified_base (456)..(456): a, c, t, g, unknown or other
  modified_base (528)..(528): a, c, t, g, unknown or other
tcagcatagtagtgcacgaccggtgctcgatttagtatctgatagttggggtttgggggggagaggagcccagcactggggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctggtgcagcctcgtgggttcagcatcagtaacgactacatgacctggcccgccaggctccgagggaagggctggagtgggtctcagttattagaaacagactggcactacatatattntgactccgtgaagggccgttcaccctctaccgagacgaccacttcccaaacaacgatcttagacttccttacgactatgaccaanaacttcagagacggtcacgacacgaccaacttagttattgcgacgcgacagtcgactaacggctcaattcgnggggccagggggacc

SEQ ID NO: 366769 - DNA, 613 bp, Homo sapiens
  misc_feature: GZ8MTXP02HJCRP.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctgggatccaggccgtggggggtcccctgagactctcctgtgcagcctcgtgggtcagcatcagtaaccgactacatcgacctgggccccgcagggctaccgaggggaaggggctgggagtggggtctcgtaagttattaggaaacagacgtcggacacgtacattaagttattccgtgaaccttccggtaggaacggggtcccggttaccaacccctctacccaggtaccgaactacctttaccaaacctaactactacgtttacgttacttcctttacactatctacactaaatctagagacgtacgacgacgaccggactacctaattcgtgtacgcgtacgaccagtcgaacctaacgctacctaattccggtcggggacccagggacccg

SEQ ID NO: 366770 - DNA, 623 bp, Homo sapiens
  misc_feature: GZ8MTXP02FNSYJ.10.38.D05.1.454.CMB.2.raw
  modified_base (464)..(464): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggagggaggctggatccagccgtggggggtccctgagactctcctgtgcagcctcgtgggttcagcatcaagtaacgactacatcgacctcgggccccgccgaggctccgaggggaaggggctgggagtgggtctcgtagttatagaaacagagtggacactacattattatctgactccggtagaacggggtccgttccaccctctccgaagacgacctacttacccaaacactattcttgtactcttacactntacgtacaactaatccgtagacgtacggtaccgaacgaccgacccggtccctaaccgttaatttagtcggtacgccggtacaaccgtactacggaacccttaacggtacccttaacgtaaacggtttccgggaccgggggacctaaggggggaaccccc

SEQ ID NO: 366771 - DNA, 573 bp, Homo sapiens
  misc_feature: GZ8MTXP02FKPXF.10.38.D05.1.454.CMB.2.raw
  modified_base (355)..(355): a, c, t, g, unknown or other
  modified_base (371)..(371): a, c, t, g, unknown or other
  modified_base (382)..(382): a, c, t, g, unknown or other
  modified_base (445)..(445): a, c, t, g, unknown or other
  modified_base (456)..(456): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagcctggggggtccctgagactctcctgtgcagcctcgtgggttcagcatcagtaacgactacatcgaccgtgggccccgccaggctccgaggggaaggggctgggaggtgggtctctagttatagaaacngatgcactacatattntctgactccgngaacggtccgttcaccctctccagacgacctacttaccaacactatcttgtactcttcacatnacacgtaaatntacgagacgtccgaacgaccgtaccgccctaacttatttacgttgacgccgacaacctatacgaacctaacggactaccgtaaacgtttccggacgggggccccgaaggggaccccg

SEQ ID NO: 366772 - DNA, 600 bp, Homo sapiens
  misc_feature: GZ8MTXP02IF25O.10.38.D05.1.454.CMB.2.raw
  modified_base (359)..(359): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactgggaggaggctggatccagccgtggggggtccctgagactctcctgtgcagcctcgtgggttcagcatcaagtaacgactacatcgacctcgggccccgccagggcctccgaaggggaaggggctgggagtggggtctcgagttatagaaacngatggacactacatattattctgactccggtgaacggggtccgttcacccctctccagacgactaccttaccaaactaactacttcgttagtacttcttacaacgtatcgacacaatcgtgagagtccgaacgaccaccggaccctaaccttaatttattggcgaccggacacctaagttcgaaaccgtaaccgacctactaaacgtttcccggggacgggggacccgaacgggggtcccg

SEQ ID NO: 366773 - DNA, 686 bp, Homo sapiens
  misc_feature: GZ8MTXP02F3644.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcagcctcgtgggtcagcatcaagtaacgactacatcgaccgtcggccccgcgaggcctaccggaaggggaacggggcgtggggaggtcggggtctacgtagttaagtagaaaacgtaggaagtcggacctaacttaactaatttaagtttacttcgtacgtaccgttaccgggtacggtaaaccgggggtccccgtttaccgtacccccttcgtaccgaacgtaacgaaccctaacttaacccaaaactaactacttacttataacttccttacaaactagttacgacaactaatcgtaagtaggacgtaccggaaaccaccggaaccggtacctaaccgttaatttacgttaggaccgcgtaaccgacctagtcgtaaaccgtcgtactacgtaaacgttcgggaccggggaccggaacgggaaccccg

SEQ ID NO: 366774 - DNA, 566 bp, Homo sapiens
  misc_feature: GZ8MTXP02IR71T.10.38.D05.1.454.CMB.2.raw
  modified_base (349)..(349): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggccccgcaggctccgaggggaaggggctggagtgggtctcagttatgaaacngatggcactacattattattctgactcggtagaacggggtccgttcaccctctccagacgacacttaccaaacactattcttagtactcttcactatcgacaacatctagagacgtcgaacgacaccggacctaaccgttattagttgacgtccgacgtacacgttcggaacctaacgtctactaaacgtttcggtacgggggcctaacggggaccg

SEQ ID NO: 366775 - DNA, 692 bp, Homo sapiens
  misc_feature: GZ8MTXP02FKNAM.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccaggcctccgaggggaaggggctgggaggtggggtctcgtagtttacgttagaaaacgaggacgtcgggaccaacgttaactaatttaatttaactttccgtacgtacccgttcccggggtagggtaaaccgggggtcccggtttacccaacccccttcgtacccgaaggacgaacctaccttacccaaaacaacctattcctttatactcctttaccaactagtcgacaacctaatcctaggaacgacggtaccgaaaccgaccgtaacccgggacccctaacctttaatttacgttacggtcggaccggtacggacctagtccgaaacccttaacggccctttaacgaacgtttccggacgggggtacccgaggggtaaccccg

SEQ ID NO: 366776 - DNA, 599 bp, Homo sapiens
  misc_feature: GZ8MTXP02HH7JO.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtggggggtccctgagactctcctgtgcagcctcgtgggttcagcatcagtaacgactacatgacctgggccccgccaggcctccgaggggaagggcgtgggaggtgggtctcgtagttattagaaacagatggcactacattattatctgactccggtagaacgggtccggtccacccgtctacccagacgacaccttaccaaacacattccttgtacttcttaccgactatcgacaactaactcgtagaagtacgtaccggaacgaccgacccggtaccaacccgtttaattacgttgtcggaccggtacgaacctagtacgaccttaacgctactaaacgtttcggcggggacccgagggggaccccg

SEQ ID NO: 366777 - DNA, 658 bp, Homo sapiens
  misc_feature: GZ8MTXP02HSX4V.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtcctgagactctcctgtgcagcctcgtggtcagcatcaagtaacgactacatcgaccgtcgggccccgccgacgggcctacccggaaggggaaggggcgtaggggaggtggggtctacgtaagtttaagttacgaaaacaggagttacggacctaactaactattaatttacttcgtagtaaccgtcccgggtagaaccggggtcccgttaccacccccttcacccgaaggacaaccctaccttaacccaaactaacctattccttagtacttcctacactagtcacaactaatctaggacgacgtccgaaacgaccgacccggtacctaaactttagtacgttcggacgaccggacaactagttaccggaaccttaacgcctaacgtaacgtttccggaccgggggaccaaacgggggacccc

SEQ ID NO: 366778 - DNA, 691 bp, Homo sapiens
  misc_feature: GZ8MTXP02JXKNS.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcgaccgtcgggccccgccagggcctccgaggggaaggggcgtgggaggtggggtctacgtagtttaattagaaacagacgtggacactacattattattctagtaccgttccggtaggaacggggtccccgtttacacccccgttctacccgaaggaacgtaaccctacccttaacccaaaacaaacctattacccgtttagttaccttccttaccaactacttcgacctaaactaaacttccgtaggaacgtaacgtcccgggaaccaacccgacccgggtacccctaaacttacgtttaacgttggtaccggaccggacctaacgtacgttacggaacccttaaccgaccttaccgtaaacgttttccgggaccgggggaccccgaagggggtaccccg

SEQ ID NO: 366779 - DNA, 669 bp, Homo sapiens
  misc_feature: GZ8MTXP02IBZIB.10.38.D05.1.454.CMB.2.raw
  modified_base (376)..(376): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctgtgggttcagcatcaagtaacgactacatcgacccgtcgggccccgccagggcctaccggaaggggaacggggctaggggaggttggggtctacgaagtttaagttaggaaaacngtaagtacggacctaactaactaatttaagtttaactttcgtacgtacgttacccggttaggaaccgggggtcccggtttacccaaccccgttctaccgacggaacgacctaaccttacccaaactaactattcttgtaactcttaccactatcgacaaactacgtactaggaagtacggtcgaaaccggacgaaaccggtccctaacgtttaacttagtttcggacgccggaactaccgagttacgaaacctcgtactactaacgttccggtcgggggaccgaagggacccg

SEQ ID NO: 366780 - DNA, 745 bp, Homo sapiens
  misc_feature: GZ8MTXP02GP0D1.10.38.D05.1.454.CMB.2.raw
  modified_base (257)..(257): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactgggtggagactggaggaggctggatccagccgtgggggtccctgagactctcctgtgcngcctcgtgggtcagcatcagtaacgactacatcgaccgtcgggccccgccgacgggccgtccggaagggggaacggggcgtggggacggtcggggtctcgtaaggtttagttacgaaaacgtagacgtcggacctacttaaacgtattactttatttccgtaggtaaccttccgggtagggtaaccgggggtcccggtttaccccaacccccgttcttaacccgaacgtaaccgtaaccctaaacccgtttaaccccaaaaacttaaacccttacttaccgtttaagttaccttcctttacccaaacgtacttacggaccctaaaactagtacccgtaaggaacgtaacggtaccggaaacccgtacggtacccggtacctaaacccgttagtttacgttgggaccgacggtaccgtaaagtttcaaccggtaaactccggtacttactaaacggtttccggcgggggtaaccggaacgggtacccgg

SEQ ID NO: 366781 - DNA, 637 bp, Homo sapiens
  misc_feature: GZ8MTXP02GSRFQ.10.38.D05.1.454.CMB.2.raw
  modified_base (267)..(267): a, c, t, g, unknown or other
  modified_base (298)..(298): a, c, t, g, unknown or other
  modified_base (317)..(317): a, c, t, g, unknown or other
  modified_base (600)..(600): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggttttccttgttgcttatttacaaaaggtgtccactgtgaggttcaacgtggtggagacgtgggaggaggctggactccgaggccggtgggggtccctgacgactctcctgtgcncgcctgtggtcagcatcaacgtaacgactanacgtcgaccgtcgggcccncgacgggctaccggaggggagggctgggaggttcgggtctacgtagttaacgtagaaacgtaggtacgtacggacctaaacgtactaagtttacttaacgttcgtacgtaccgttaccgggtaggaacccgggggtcctttacccaacccgtctaccgaacgcggacctaaccttacccaaactactaactctttactactcttacactagtacactaatactgacgtagactacggacaccgacgtactaacgttattagtgtcgcacgactacgtcaaccngtactacgtacgttcggacggggaccgaacggacccg

SEQ ID NO: 366782 - DNA, 533 bp, Homo sapiens
  misc_feature: GZ8MTXP02HTQEY.10.38.D05.1.454.CMB.2.raw
  modified_base (303)..(303): a, c, t, g, unknown or other
  modified_base (356)..(356): a, c, t, g, unknown or other
  modified_base (403)..(403): a, c, t, g, unknown or other
  modified_base (444)..(444): a, c, t, g, unknown or other
  modified_base (476)..(476): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaaactggtggagacgtggaggaggctgggatccagcctggggggtcccctgagactctcctgtgcagcctctgggttcagcatcagtacgactacatgacctgggccccnccagggctccgaggggaaggggctgggagtggggtctcgagttattagaaacngactggcactacatattatctgactccgtgaagggccgttcaccctntccagagacacttcaaacacatcttgtatctcacatgccanaatctgacgagtcgacgacacggccaaccttnttattcgagcgacgacagtcgactaacgctacgaacttcgtcggggaccaggggacc

SEQ ID NO: 366783 - DNA, 654 bp, Homo sapiens
  misc_feature: GZ8MTXP02JZWV0.10.38.D05.1.454.CMB.2.raw
  modified_base (379)..(379): a, c, t, g, unknown or other
  modified_base (384)..(384): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtggggggtccctgacgactctcctgtgcacgcctctgggttcagcatcagtaacgactacagtcgaccgtcgggccccgccgacggcctccggaaggggaaggggctgggaggtgggtctactagttatagaaaccagatggacanacatnttatctacgacttcgaggtaacgggcccggttaccacccctcgtacccgaagacgtaccctacttaacccaaactaaactacttacttagtacttaccttacacgtatcgtaccaaactaattaccgtaggaacggtacgtaccggaaccgacccgtaacccggggtcctaaacccgtttattaacggtttcgtcggaccgtaccgaaccgtacttaacggtaccctacggtctaaccgtaacggtttccggggtacgggggaacccggg

SEQ ID NO: 366784 - DNA, 717 bp, Homo sapiens
  misc_feature: GZ8MTXP02I38Z9.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaacgtggtggagacgtggaggaggctggatccagtccgtgggggtccctgacgactctcctgtgcacgcctcgtgggttcagcatacagtaacgactacatcgacccgtcgggccccgcgaggtcctaccggaggggaacggggcgtagggtaggtcgggttctcgtagtttattacgaaacgtagactcggacactactaattacttacttcgtacgtaccgttccgggtacggaaccgggggtcccgtttacccaaccccttcgtacccgaacgtaacgtaaccctaaccttacccaaaactaccttattcttacgtactcctttacaacctagtacaactaaccgtaaattcccgtaaggaacggtacggttaccgaaaccgaccgtaaacccggtccccttaaacccttaaacgtttacgtttcggtacggaccgtaaaccggtacctaagttacggaacccttaacggcttaaccgtaacggttccggggtaccgggggaaccacgggggtaaacccccg

SEQ ID NO: 366785 - DNA, 616 bp, Homo sapiens
  misc_feature: GZ8MTXP02G1CNK.10.38.D05.1.454.CMB.2.raw
  modified_base (288)..(288): a, c, t, g, unknown or other
  modified_base (305)..(305): a, c, t, g, unknown or other
  modified_base (332)..(332): a, c, t, g, unknown or other
  modified_base (363)..(363): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggtcagcatcaagtaacgactanatcgacctcgggccccncgacggcctaccggaggggaacggggngtgggaggtgggtctcgtagttatagaaacngagtcggacactacattattattctcgactccggtaggaaccgggtccgttaccaccccttcgaccaggaacacctaaccttcccaaaacaacttcttccttagtaacttccttacaactattcgaacacgtaacttcgagacgtcgtaccgacgaccgaccggtacctaaccgtttatttacgtcggtcgcggtaccacacgttgaaacctcgacctagtaacggttccggacggggaccagggggaacccc

SEQ ID NO: 366786 - DNA, 642 bp, Homo sapiens
  misc_feature: GZ8MTXP02I8RHF.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtcctgagactctctgtgcagcctcgtgggttcagcatcaagtacgactacatcgaccgtcgggccccgccacggctaccggaggggaaggggcgtgggacggttgggtctacgtagttattacgaaaacagacgtcggacaactaactagttaattacttcgtacgtaccgtccggtaggaacggggttcccgttcctaccctcgtacccgtaagaacgtacctaccttaaccaaaacactacttctttagtacttctaccactagtacgactaacaagtccgtaaggagtaacgccgaaacgaccgaccgacctaaccgttattacgtggtacgaccggactaacgtactcggtaaacctaaccggtctaacgtaacgttccggacgggtaccgaaggtaccccg

SEQ ID NO: 366787 - DNA, 591 bp, Homo sapiens
  misc_feature: GZ8MTXP02J0ZQC.10.38.D05.1.454.CMB.2.raw
  modified_base (303)..(303): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggggttttccttgttgctattttcaaaaggtgtccactgtgaggttcaactggtggagactggaggaggctggatccagcctggggggtccctgagactctcctgtgcagcctctgggttcagcatcagtaacgactacatcgacctgggccccnccaggctccgaggggaaggggctggaggtgggtctcagttattagaaacagatggcactacatacttatctgactccgtgaacgggtccggttacaccctctccagagacaccttccaacaacattcttgtactcttacactatgaccactaaactctagaggtacgtcggaaccgtacaccgggaccctaccttaattaacgttcggtcgaccggcgtaaccgactacggtaacctaaccggtctacctaaacgtttcggtaccgggggacccaaagggggtccccg

SEQ ID NO: 366788 - DNA, 828 bp, Homo sapiens
  misc_feature: GZ8MTXP02HPFI5.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcttgggttttccttgttgctatttacaaaaggtgtccactgtgtaggttcaacgtggtggagacgtgggaggaggctggactccgacggccggtcggggggtccctggagtactctcctgtgcacgtccgtgtggtcagcatcaagtaacgactacagtcgaccgtcgggccccgccgaggccgtaccggaagggggaacggggcgtaggggtaggttcggggttctacgtaagtttaagttaacggaaacgaggtagtacgggactaaccgttaacttaatttaacttttaacttccgtacgggttaaccttcccggggtaacggggtaaacccggggttccccgggttacccctaaccccctcccgttaacggaaaccggtacgtaacccctaacctttaacccaaaacttaacttacttacccgtttacttaacttcccttaacgaacttacggtacgtaaacccaacttaaacggttccgttaaggaaccggtacgttaaccccgggaaaccgtaacccgaacccgggtacccctttaaaaccggttttaagtttaacggtttcggaaaccgggtccaaacccggttaaacgtacgttaacccggtaccttaaccgtaccgttaaaccgttacggggtaccggggtacccgggggtaacccggtaacgggaccccg

SEQ ID NO: 366789 - DNA, 621 bp, Homo sapiens
  misc_feature: GZ8MTXP02HHRFC.10.38.D05.1.454.CMB.2.raw
  modified_base (313)..(313): a, c, t, g, unknown or other
  modified_base (392)..(392): a, c, t, g, unknown or other
  modified_base (429)..(429): a, c, t, g, unknown or other
tcagcatagtagtgcacgaccggtgctcgatttagtatctgatagttgggtttggggctgggagaggagcccagcaccgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccagcgttcgggggtccctgagctctcctgtgcacgcctcgtggttcagcatacaagtaacgactacatcgacccgtcgggccccnccgacggctaccggaggggaacggggcgtagggacggtggtctacgtagttatagaaacagagtgacactacattattntctacgtactcgtaggacgggtcccgttaccaccctntacccaagaccgactaacccttaccaaactaactacttcgttacttacttaccttacgaaactacttcgacctaactaatccgaagtagacgtaccggaaccgactacggccctaacgttatttggttgccgtacgaccgaactctacgaaccttacgacctattaacgtccggtacggggaccaacggggg

SEQ ID NO: 366790 - DNA, 612 bp, Homo sapiens
  misc_feature: GZ8MTXP02I1C3G.10.38.D05.1.454.CMB.2.raw
  modified_base (305)..(305): a, c, t, g, unknown or other
  modified_base (475)..(475): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgagccgtgggggtccctgagctctcctgtgcagcctcgtggtcagcatcagtaaccgacacagtcgaccgtcgggccccnccgaggcctccggaggggaacgggtcgtaggggagtcggggtctacgtagttatagaaactgatggacacgtacattacttcttcgtgtactaccggtggaacgggtcccggttaccaccctctccgaaggactaccacttaccaaacactaattcttagtactccttanactatcgacactactcgtacggaagtacgtacgaaccgtaccgaacccggtccctaacttatttagtggtcgaccgacgtacacgtcggtaacctaacgccttaacgacgttccgcgggggacctaggggaaccccg

SEQ ID NO: 366791 - DNA, 543 bp, Homo sapiens
  misc_feature: GZ8MTXP02HB3PF.10.38.D05.1.454.CMB.2.raw
  modified_base (299)..(299): a, c, t, g, unknown or other
  modified_base (307)..(307): a, c, t, g, unknown or other
  modified_base (331)..(331): a, c, t, g, unknown or other
  modified_base (361)..(361): a, c, t, g, unknown or other
  modified_base (377)..(377): a, c, t, g, unknown or other
  modified_base (416)..(416): a, c, t, g, unknown or other
  modified_base (424)..(424): a, c, t, g, unknown or other
  modified_base (450)..(450): a, c, t, g, unknown or other
  modified_base (455)..(456): a, c, t, g, unknown or other
  modified_base (458)..(458): a, c, t, g, unknown or other
  modified_base (460)..(460): a, c, t, g, unknown or other
  modified_base (462)..(462): a, c, t, g, unknown or other
  modified_base (464)..(464): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtcgggggtccctgagactctcctgtgcagccctgtgggttcagcatacaagtaacgactacatcgaccncgggcccncgacggcaccgaaggggaacgggntgggagtcgggtctacagttaatagaaacngaagtcgactactaanattacttaatctgaactcgtagaacggggtctccacctnaccagtanaacactcaaaacatgtctgactctancgtannananananagagagacgacgacacgactactactatgcgcgacacacacgactaacgtactactacgtacgtacggacggacggacg

SEQ ID NO: 366792 - DNA, 600 bp, Homo sapiens
  misc_feature: GZ8MTXP02I1DPZ.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccgagccgtgggggtccctgagactctcctgtgcagcctcgtgggttcagcatcagtaacgactacatcgaccgtcggccccgccacggcctaccggaggggaacggggctgggaggtcggggtctcgtagttatagaaaactagacgtggactactactaattattattctacgtacctccggtagacggggtcccgttccacccctactcgaagacgaccacttacccaaacactattctagtactccttacactatacgtacaactaatactagaacgtacgtacgaaccgacaccggaccctaacgttattagttgacgtcacgacatacgaccttaacgctacgtaacgttcggtacggggaccgacgggacccg

SEQ ID NO: 366793 - DNA, 606 bp, Homo sapiens
  misc_feature: GZ8MTXP02FEUCE.10.38.D05.1.454.CMB.2.raw
  modified_base (390)..(390): a, c, t, g, unknown or other
  modified_base (472)..(472): a, c, t, g, unknown or other
  modified_base (559)..(559): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatacagtaacgactacatcgaccgtggccccgcgaggcctaccggagggggaaggggcgtgggaggtcgggtctcgtaagttatagaaacagacgtggaccactactattattattcncgacttaccggtaggaacggggtcccgttaccacccgttctaccgaaggaccactaccttacccaaacaacgtattccgttntaacttcttacacgatcgacaactaaagtcgagagacgtcgaacgaccgacgaccctaacttagttacttgcgacggacacttaacncgtacaaccacgtaacgtaacgttccgggacgggaccgacggacccg

SEQ ID NO: 366794 - DNA, 541 bp, Homo sapiens
  misc_feature: GZ8MTXP02FGJDO.10.38.D05.1.454.CMB.2.raw
  modified_base (303)..(303): a, c, t, g, unknown or other
  modified_base (374)..(374): a, c, t, g, unknown or other
  modified_base (398)..(398): a, c, t, g, unknown or other
  modified_base (487)..(487): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgaccgtgggccccncaggcctccgaggggaaggggctgggagtgggtctcgagttatagaaacagatggacactacatattatcngactcgagacggtcgttcaccctntcccagacacaccttaccaacaacatcttgtatcttacacatgcaacaatctgaagacgtacgacgacgaccggcccacttagttatgngccgcgacactagacctaacgctactaacgttcgtacgggggaccagggacccg

SEQ ID NO: 366795 - DNA, 588 bp, Homo sapiens
  misc_feature: GZ8MTXP02GV3S6.10.38.D05.1.454.CMB.2.raw
  modified_base (520)..(520): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgaggccgtgggggtccctgagactctcctgtgcagcctctgggttcagcatcagtaacgactacatgaccgtcggccccgcaggcctccgaggggaggggctggagtgggtctcgagttatagaaacagatcggacactacattattatctagactccggtagaacgggtcccgtctaccctctaccagacgacctacttaccaaacctaactatactttcgtattccttacacctagtcactaactattccgagtacgacgttaccgaacgaccgccgtacctaccttaagttntcgtacggccacggacacgtcgaacctaacgtctaacgtacgttccggacgggacccgaggggacccg

SEQ ID NO: 366796 - DNA, 729 bp, Homo sapiens
  misc_feature: GZ8MTXP02IWE8M.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagacgtggaggaggctggatccaggccgtgggggtccctgagactctcctgtgcagcctcgtgggttcagcatcaagtaacgactacactcgacccgtccgggaccccaccgacgggtccgtaccggaagggggaacggggtcgtagggacggttcggggtcgttacgtaggtttaagttacgaaaacgtcggtaacgtacgggacctaacttaactaactttaactttacttcgttacgaccgttacccgggtaggtaaccgggggtcccgtttacccacccttcgtaccgaagaaccgaacctacccttaacccaaactaccgttattccgtttagtacttaccttacaaactagttacaacctaacctaattccgaggaacggtacgtacccggaaaccgaccgaaccggtacccttaaacgtttaagttcgttaacggtcgaccccgtagaactacggttaccaaccgttaaccgtctaaacgttaccggttcgggaccggggtacaaccgggggtaaccccg

SEQ ID NO: 366797 - DNA, 683 bp, Homo sapiens
  misc_feature: GZ8MTXP02I1ZMJ.10.38.D05.1.454.CMB.2.raw
  modified_base (633)..(633): a, c, t, g, unknown or other
  modified_base (637)..(637): a, c, t, g, unknown or other
  modified_base (641)..(641): a, c, t, g, unknown or other
  modified_base (647)..(647): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccaggccgtgggggtcacgtgagactctctgtgcagcctgtgggtcagcactcagtaacgactacagtcgaccgtcggccccgcgacggccgtaccggaaggggaacggggcgtgggagggttcggggtactcgtaagtttaagttacggaaaacaggtacgtcggaacctaacttaactaaattaacttttacgttccgtacggtaaacccgttcccggtaacggggtaaacggggttccccggtttacccaaaccccgttcccgtaacccgaaacggtaaaccgtaaccctaaccctttaaccccaaaacctaaacctacgtttacctttagttaacctttacccttaacaaacgtacttcgacctaactaatacgtagacgtacgacgaacacgacgacctactatntcgngacncgaacntacgaactacgactactagtcggacgggacaacggg

SEQ ID NO: 366798 - DNA, 591 bp, Homo sapiens
  misc_feature: GZ8MTXP02FR37J.10.38.D05.1.454.CMB.2.raw
  modified_base (221)..(221): a, c, t, g, unknown or other
  modified_base (364)..(364): a, c, t, g, unknown or other
  modified_base (388)..(388): a, c, t, g, unknown or other
  modified_base (502)..(502): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaaggggctggagtgggtctcagttattgaaacngatggcactacattattatctgactccgtgaagggccggttcaccctctccagacgacacttccaacaacatcttgtatcttcacatgacacaatctagagacgtcgacgacacggccaacccttattatgtcgcgcgaactntcgactacgctactaaagtttcgnggggaccaggggacgcccgaggtccacccgtcctcccccagcccctaccgaaccgacgggcccctacgtcccggttcccttcccccgtggcccgtcccctcgcctccgaggacnccaccgtccgagacgcaccgacggccggcccgtcgggcctcggccgtcggtaccgaaacggtacctacctttccccaacgttacctacg

SEQ ID NO: 366799 - DNA, 648 bp, Homo sapiens
  misc_feature: GZ8MTXP02GVRZZ.10.38.D05.1.454.CMB.2.raw
  modified_base (367)..(367): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagacgtctcctgtgcacgcctcgtgggttcagcatcaagtaaagactacatgacctcgggccccgccgaggcctccgaaggggaacggggcgtgggaggtcgggtctacgtagttattacgaaaacngaacgtcggactaactacattattacttcgtcgtacgtccggtaggtaacggggcccgtttaccaccccgtctaccgaagacgaacctacctacccaaacaacctatcttagtactcttacactatcgacacctattcgacgagacgtcgaaccgaccgtaaccgaccctaacctagtttacgttcggtcgacccgtcggtaaactacgtccggtaaactaacccgtactaaaccttaacgtttccgggaccgggggtcccgtaaaacggggggacccccg

SEQ ID NO: 366800 - DNA, 582 bp, Homo sapiens
  misc_feature: GZ8MTXP02HH46T.10.38.D05.1.454.CMB.2.raw
  modified_base (299)..(299): a, c, t, g, unknown or other
  modified_base (316)..(316): a, c, t, g, unknown or other
  modified_base (430)..(430): a, c, t, g, unknown or other
  modified_base (455)..(455): a, c, t, g, unknown or other
  modified_base (461)..(461): a, c, t, g, unknown or other
  modified_base (470)..(470): a, c, t, g, unknown or other
  modified_base (475)..(475): a, c, t, g, unknown or other
  modified_base (480)..(480): a, c, t, g, unknown or other
  modified_base (484)..(484): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtgggaggaggctggactccgaggccggtgggggtccctgacgtactctccgtgtgcacgcctcgtgggtcagcatcagtaacactanatcgaccgtcggccccncaggcctcgaggggagggctgggagtgggtctgaagttagtagaaacaggactggacaactacattaattacttcgtcgtactccggtagaacggggttcccgtaccacccttnaccgagacactactaccaaataacnttcttntactcgtanactancacanatcngacgacgacgaacgtaccgaccgtactaacgtttatacgtgcgacgacactacgtacgtaactcgtactacgtacggtcggacgggaccgacggaccg

SEQ ID NO: 366801 - DNA, 704 bp, Homo sapiens
  misc_feature: GZ8MTXP02JRT4M.10.38.D05.1.454.CMB.2.raw
  modified_base (281)..(281): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtggaggaggctggatccgaggtccggtgggggtccctgagactctcctgtgcacgcctcgtggtcagcancaagtaacgactacagtcggaccgtcgggccccgccgacgggccgtaccggaagggggaacggggtcgtaggggtaggttcggggttccttacgtaaggtttaagttaaggaaaacgagtacgtcggacctaactaactattaattattccgtacgacgttccggtaggtaccgggtcccggttacccacccgttctaaccgaagacctaacctacccttaacccaaaactactactttcgttaatacttaccttacaacgtatccaactaaactacgtcgaagaggtaccgaaccggacgaaccgtaccggtaaccccttaaagtttagtttacgttccggacggacctacgtaacgtacgtaccgtaaccgtaagaccttaacgtacggtttccggggacggggacccgaagggtaccccg

SEQ ID NO: 366802 - DNA, 655 bp, Homo sapiens
  misc_feature: GZ8MTXP02GPILJ.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggttcagcatcagtaacgactacatcgaccgtcggggccccgccgaggcctccgaaggggaacggggctgggaggtgggtctacgtagttatagaaacagacgtggacaactacgtattattattccgtacgtaccgttccggtaggaaccggggtcccggtttaccaacccccttcgtacccaaggacgaacctaccttaacccaaactaacgtattcttacgtacttccttacactatcgactaactaatcctaggagtacgtaccggaaacgaccgaccggtaccctaaccgttaatttacgttcgtacgaccggacaccgtatcggtaacctaaccggtaccttacgtaaacgtttccggacgggggacccgaaggggtacccccg

SEQ ID NO: 366803 - DNA, 627 bp, Homo sapiens
  misc_feature: GZ8MTXP02JP23U.10.38.D05.1.454.CMB.2.raw
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggtcagcatcaagtaacgactacatcgacctgggccccaccgaggcctaccgaggggaacggggctagggaggtgggtctcgtaagttaagtagaaaaccgagagtaggaccaactaacaattattacttcgtcgaaccgttcccggtaggaaacggggtcccggtttaccaaccccttaccgtacccgaaggacaaccctaactttacccaaaacctaaacgattaccttagttaactcttacaacatacacacaaattcgagagacgacgacgaaacgacccggacctaacctattaacgttggacgaccgacgtaacgataacgtacgtaacgtactactacgtacggtacgggaccgg

SEQ ID NO: 366804 - DNA, 581 bp, Homo sapiens
  misc_feature: GZ8MTXP02FYXHD.10.38.D05.1.454.CMB.2.raw
  modified_base (361)..(361): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccagccgtgggggtccctgagactctcctgtgcagcctcgtgggttcagcatcaagtaacgactacatcgacctcgggccccgccaggcctaccgaggggaaggggctgggagtggggtctcgtagttatagaaaacngatgcactacatattattctgactccgtagaacggggtccgttacaccctctccagacgacaccttaccaaacactactacgttctacttcttacacctaatacgtcaactaactactcgaaggagtacgacgacgaccgaccaacccttattagttcgtcgcgtaccgactactgactaaacgtctactaacgtacgtcggggaccggaacggaaccgg

SEQ ID NO: 366805 - DNA, 649 bp, Homo sapiens
  misc_feature: GZ8MTXP02FPPW4.10.38.D05.1.454.CMB.2.raw
  modified_base (513)..(513): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgaggccgtcgggggtcctgacgactctcctgtcgcacgtcctcgttgggttcagcatacgaagtaacgactacagtcgaccgtcggccccgccaggctccggaggggacggggcgtgggaggtcgggtctcgtagttactagaaacagagtgactactaactattaattattcgtcgtaccgtccggtacgggaaccggggtcccggttacctacccccgtctacccgaagtacgaaacctaccttaacccaaaacaactacttcttagtaactctttacgaaacctntacgacaactaatcgtagagacgtacgaccgacgaccggccctaacgttagtttactggtcgacgacgtaacactaccgtaaactaaccggtactaaccgttacggttccggtacgggggacctacggggaacccg

SEQ ID NO: 366806 - DNA, 625 bp, Homo sapiens
  misc_feature: GZ8MTXP02IZM61.10.38.D05.1.454.CMB.2.raw
  modified_base (227)..(227): a, c, t, g, unknown or other
  modified_base (242)..(242): a, c, t, g, unknown or other
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcaccatctcctgcactggaaccngcagtgtactttgtnctttaataactatgtctcctggtaccagcaccacccaggacaaacgccccaaactcctttgtttcgagtcaagtaacgcggtcctcgacggtacgtcctgacgttcggtctctcgcctcagtctgacacgcggcctcctcgtaccgtctcgtcgggacctccgaggctaggaggtactggacggtctagtacgtttacgttactgttacgtctacagttacgtgacgtacggtccgtacggtcgtttggggtcgttcgggacggtaggggaacctacggtaccgtcgtacccgttacggtacggtaccgaccgtacccggaacggtcccgttacccggcccccgttaccggtcctaccttcccggtttcccggtttccccccg

SEQ ID NO: 366807 - DNA, 588 bp, Homo sapiens
  misc_feature: GZ8MTXP02F40QG.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccaggcctccgaggggaaggggctgggagtggggtctcgtagttagtagaaacagatggacactacaattattattcgtgactccggtagaacggggtccgttccaccctctccaggacactacttaccaaacactatctgtactccttacaatatcgacacaatctagagacgtccgacgaccgacggaccctaacttattacgtgtacgcgtaccgtacacgttacgaaccctaacggaccttacgtaaacgtttcggaccggggaccgaagggggacccg

SEQ ID NO: 366808 - DNA, 590 bp, Homo sapiens
  misc_feature: GZ8MTXP02FYUB4.10.38.D05.1.454.CMB.2.raw
  modified_base (301)..(301): a, c, t, g, unknown or other
  modified_base (350)..(350): a, c, t, g, unknown or other
  modified_base (453)..(453): a, c, t, g, unknown or other
  modified_base (473)..(473): a, c, t, g, unknown or other
  modified_base (486)..(486): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctgtgggtcagcatcagtaacgactacatcgacctggcccncaggctccgaggggaagggctgggagtgggtctcagttattagaaaccngatggacactaacattattatctagacctccgtaggaacgggtcccgttaccaccccgtctaccgaagtacaacctaccttacccaaaactaacctattactnttaaacttccttacaacgtntacgaccctaaanaacttcgtagacgtaacgtccgaacgacaaccggcctaaacttattacgttcgacgcgaccgatataacggacctacgctactaacgtttcggacgggaacccg

SEQ ID NO: 366809 - DNA, 554 bp, Homo sapiens
  misc_feature: GZ8MTXP02IV1YC.10.38.D05.1.454.CMB.2.raw
  modified_base (302)..(302): a, c, t, g, unknown or other
  modified_base (369)..(369): a, c, t, g, unknown or other
  modified_base (400)..(400): a, c, t, g, unknown or other
  modified_base (415)..(415): a, c, t, g, unknown or other
  modified_base (430)..(430): a, c, t, g, unknown or other
  modified_base (446)..(446): a, c, t, g, unknown or other
  modified_base (460)..(460): a, c, t, g, unknown or other
  modified_base (488)..(488): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggcccnccaggctccgaggggagggctggagtgggtctcagttatagaaacagactggcactacattattatntgactcgtgaacgggtcgtacaccctctcanacgacactcaaacanatctatactctacanatcgcaacatactganacgtcgaaccgtanaccggacctaaccttattacttggtacncggtcgaactacgtacgacttaacgcttaactaaacgtttccggacgggggcccaagggggtaccc

SEQ ID NO: 366810 - DNA, 575 bp, Homo sapiens
  misc_feature: GZ8MTXP02JKG5X.10.38.D05.1.454.CMB.2.raw
  modified_base (221)..(221): a, c, t, g, unknown or other
  modified_base (285)..(285): a, c, t, g, unknown or other
  modified_base (299)..(299): a, c, t, g, unknown or other
  modified_base (301)..(301): a, c, t, g, unknown or other
  modified_base (351)..(351): a, c, t, g, unknown or other
  modified_base (387)..(387): a, c, t, g, unknown or other
  modified_base (458)..(458): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgcaggctccgaggggaaggggctgggagtgggtctcagttattgaaacngatggcactacatattatctgactccgtgaggccgttcacctctccagagacactccaacaacntcttgtatctcacntncacaatctagagagtcgacgacacggccaacccttattatgtgcgagacntgaactacgctactaagttcgtggggaccagggacncccgaaggtcaacccgtcctccccgagccctccaacccgaacggaccccacgtccggttcccttcccccgngcccgccctgccctcgaacggcgcctacccgtcgaacgcgaccaacgccggccggtcccgtcggggtcctcggcccgtggtaccgaaaacggtcctacctttaccccaattacctag

SEQ ID NO: 366811 - DNA, 774 bp, Homo sapiens
  misc_feature: GZ8MTXP02JH89R.10.38.D05.1.454.CMB.2.raw
tcagcatagtagtgcacgaccggtgctcgatttagtatctgatagttgggttttccttgttgctatttcaaaaggtgtccactgtgaggttcaactggtggagactggaggaggctggatccagcctggggggtccctgagactctcctgtgcagcctctgggttcagcatcagtaacgactacatgaccgtcgggcccgccgaggctccgaggggaaggggctgggaggtgggtctcgtagttatagaaacagatggcactacatattatctgactccgtgaacgggccgtcaccctctccagacgacacttaccaaacactatcttagtacttccttacactatcgacaactaaatcgtagagtacgtaccgaaccggaccaaccggccctacctttatttaagtttcggtcgaccgtacggaacctagtaccgaactaacccggtcttacgtaaacgtttcccgggtacgggggacccgaagggggacccgtccccgaacgggtccccaacccggttcccctacccccgacgtaccccctacccgaaacccggaaccggggccccctaacggttcccccgggtttccccctttccccccgggcgggtcccccgtcccccgtccggtccccgttacccccggaaaggggtaccccggtaaccccaaccccggttacccgggaacggaccggaaccccgaaccggttaacccggggcccccggggtcccgggttccggggaacccgttcccggggtacccgtttaaccggggg

SEQ ID NO: 366812 - DNA, 657 bp, Homo sapiens
  misc_feature: GZ8MTXP02IATYE.10.38.D05.1.454.CMB.2.raw
  modified_base (487)..(487): a, c, t, g, unknown or other
  modified_base (632)..(632): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtgggggtccctgagactctcctgtgcacgcctcgtggttcagcatcaacgtaacactacatcgaccgtcgggccccgcgacggcctaccggaaggggacgggcgtgggaggtgggtctagtagttaattagaaacagagtcggactaactactattaattattcgtagtactccggtaggtaacggggtcccgtacacccctctacccgagaaccgtactacccttaaccaaaactactacttcgtattatccttanacctaaatcgaactactaaactcgtaaggaacggtacgtcccgaaacgtaccgaaccgtccctaaaactttgttaactttcggacgcgtaccgtaacacgttacggaaacctaaccggtactttaacggtaacgtttcccggggngggggaccctaaaacgggggtcccc

SEQ ID NO: 366813 - DNA, 607 bp, Homo sapiens
  misc_feature: GZ8MTXP02FI501.10.38.D05.1.454.CMB.2.raw
  modified_base (269)..(269): a, c, t, g, unknown or other
  modified_base (351)..(351): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagctctgggttcngcatcagtaacgactacatgacctgggccccgccaggcctcgaggggaaggggctgggagtggggtctcgagttatgaaacngatgggcacgtacatatttattcgtgacttccggtgaaacggggtccggttccaccccgttctcccaacgacgaccaccttacccaaacgaacaacttcctttagtactctttaccacgtaaatcgaccactaaactctaggacgtacggtccgaacgaccaccgggacctaaccctatttaacgtggtacgccgtacggactaactgtaaccctaacgcctacgtaacttcggtcgggggaccaacgggggaccc

SEQ ID NO: 366814 - DNA, 709 bp, Homo sapiens
  misc_feature: GZ8MTXP02JDJ8V.10.38.D05.1.454.CMB.2.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtccatcaccatctcctgcactcggacccaccagttacattggtaataatgaatatgtctcctggtaaccaacacgtacccaggcaaacgacccccaaatgatgatttatgtatgtcagtaactcgaccctgtagggtttctgatcgtcttcctttgccttcaagttctcggactaccgcgaccctcccgtagaccacttcctcgttcggggaccttacccgaacgtaccgtagggaacgggaaccgacggggtaccttagtaagtttaacttaacgttcggactaacggtccttaccgaaactaaacgtaaccgaaaacggccggtacggaacggggttcggggtttagggggttcggggtttccgggggaccgggggggtaaccctaccggaaaccggttcggtaaaccccgggtcccgtttaacggggaccgttaaccggaccccgtaaacgggcccgtttacccggcccccgttacggtccccttaaccgtttacccgtttacccccgg

SEQ ID NO: 366815 - DNA, 609 bp, Homo sapiens
  misc_feature: GZ8MTXP02JVCKG.10.38.D05.1.454.CMB.2.raw
  modified_base (438)..(438): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctattcaaaaggtgtccactgtgaggttcaactggtggagactggaggaggctggactccgagccgtgggggtccctgagactctcctgtgcacgcctcgtggttcagcatcaagtaacgactacatcgaccgtcgggcccgccgaggcctaccggaaggggaacggggtcgtgggtaggtgggtcctacgtaggttatagaaacccagatcggactacgtacattattatctcgtactccggtaggaacgggtcccgttaccacccgttcncgaacgagaacctaccttaaccaaacaacagtttaccttagtaacctcttacactatcgacaactaactcgtagacgtacgtaccgacgtacaccggtacctacgttattacgtcgacgcgacgactacgtaacgactacgtctaccgtaacgtttccgggacggacccgg

SEQ ID NO: 366816 - DNA, 722 bp, Homo sapiens
  misc_feature: GZ8MTXP02HXVD4.10.38.D05.1.454.CMB.2.raw
  modified_base (486)..(486): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagtttggctgagctgggttttccttgttgctatttcaaaaggtgtccactgtgaggttcaactggtggagactggaggaggctggatccgagccgtgggggtccctgagactctcctgtgcagcctcgtggtcagcatcaagtaacgactacatcgaccgtcgggccccgccgacggcctaccggaaggggaacggggcgtagggaggtcggggtctacgtagtttagtaagaaacgagtacgtcggactaacgtactaattagtttacttctacgtacgtccggtacggtaaccgggtcccggtacctaccccgtctaccgaaggaccctaacctaaccttaccccaaaanaaccttattaccgtttacgtactttacctactaaacgacgttacacctaaaactaactttcgaagtaaacggacggttaacccgaaaccgaaacccggacccgggttaaaccccctaaaccgtttaagtttaaacggtttcgaacggaccggtaccaaacgttacgaacccgttaacaaccgtccttaaaccggtaacgtttcccgggaccgggggaccgaaaaccggggccccgg

SEQ ID NO: 366817 - DNA, 672 bp, Homo sapiens
  misc_feature: GZ8MTXP02HCXZX.10.38.D05.1.454.CMB.2.raw
  modified_base (270)..(270): a, c, t, g, unknown or other
  modified_base (530)..(530): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagcgttgggttttccttgttgctatttacaaaaggtgtccactgtgtaggttcaacgtggtggagacgtggaggaggctggactccgagccggtcgggggtccctgacgtactctcctgtgcncgcctgtggtcagcatcagtaacgactacatcgaccgtccggccccgacgacggccgtaccggaggggaacggggcgtgggtaggtcgggtctacgtagttagtacgaaaccgtagagtcggactacgtactaattatttacgttcgtagtaccgttccggtacgggtaaccggggtcccgtttaccacccgttcctacgaacggaccacccttaaccttaccaaactaaacttctttaccgttagtacttccctttaanaccgtatcaacctaactatcgtaggacgtcggaccgaaccgtacccgacccgttactaacgtttagttaccggtgccggaccgactacgtaacgtaacgtaccgtacgtacttacggtacggtttccggggacccggggacg

SEQ ID NO: 366818 - DNA, 617 bp, Homo sapiens
  misc_feature: GZ8MTXP02FXUH3.10.38.D05.1.454.CMB.2.raw
  modified_base (370)..(370): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctgggatccgagccgtgggggtccctgagactctcctgtgcagcctcgtgggttcagcatcagtaacgactacatcgaccgtcgggccccgccgaggcctccggaaggggaaggggcgtggggacggtggggtctcgtagtttatagaaaacgngatggacaactacattattacttctcgtaaccgtccggtaggtaacggggtcccggttaccaccctcctacgaggacacctacttacccaaacacctattctttgtactcttacaacatgacctaactaattccaggactacggtaccgacgacgaccggcccctaattaatttcgttggtcgaccgacgactagtcgaacctaacgcctaacgtaacggtttcgacggggacccaaggggaccccg

SEQ ID NO: 366819 - DNA, 740 bp, Homo sapiens
  misc_feature: GZ8MTXP02HZZ24.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactgggaggaggctgggatccagccgtgggggtcctgagactctctgtgcagcctcgtgggtcagcatcagtaacacacatcgaccgtcgggccccgcgacggctccggaaggggaacggggcgtggggacggtggggtcttcgtaggtttaattaggaaaactagacgtggacctaacgtactaattagtttacttcgtacgtaccgttacccggtaggggtaaacccggggttcccggttacctacccccgttactacccgaaacggtacgaaaccctacccttaacccaaaacctaacgttaactttaccgttacgttaaacttccctttaacacgtaacttcggaacctaaactaacgtccgtaggtaacgaacggttacccggaaaccgaccgaaccggacccttaaaccttacgtttaacgttgggtaccgaccggaacgtaaccgacgttaacgaaaccggttaaccggtaccttaacgtaaaccggtttccggggaccgggggtacccggtaacgggggtaccccgg

SEQ ID NO: 366820 - DNA, 751 bp, Homo sapiens
  misc_feature: GZ8MTXP02HABOS.10.38.D05.1.454.CMB.2.raw
  modified_base (415)..(415): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgctatttacaaaaggtcgtccaccgtgaggttcaacgtggtggagacgtgggaggaggctggactccgacggtccggttcgggggggtccctggacgtaccttccgtcctggtcgcgacgtccgttcgtgggtcacgctaatacgtaagtaaaccgactacagtcgaccgtcgggaccccgcgacggtccgtaccggaaggggacggggcgtgggaggttcgggtacctacgtagttataagaaaacgngtagtaccggactaacgtactaatttaactttacttcgtcggtaccgtaccgggtacgggtaaccgggttcccggttaccctaccccttacctacccgaacggtaaccaaccctaccttaaacccaaaactacctattactttactactttacctacgaactagttcactaaacacttccgtaaaggaacgtaccggtaaccgaaccgaccggtaacccgtacccttaaacgtttactttaacggtcggtcggaccgtacgaaacgtacgtacgtaaccgtaaccgcgttaaacgtacggttccgggacggggaccgacgggggaccctacccggg

SEQ ID NO: 366821 - DNA, 652 bp, Homo sapiens
  misc_feature: GZ8MTXP02FFM4L.10.38.D05.1.454.CMB.2.raw
  modified_base (352)..(352): a, c, t, g, unknown or other
  modified_base (374)..(374): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccacgccgtggggggtccctgagactctcctgtgcagcctctgggttcagcatcagtaacgactacatcgaccgtggccccgcaggctccgaggggaagggctggagtgggtctcgtagttatagaaacngactggcactacatattattcngactcgtagaacggtccgttcacccgtctccaagacgacaccttacccaaacaactacttcttagtacttcttaccacacgttcgaccaactaacttcgacgtaacggtaacgcccgaaaccgacccgaaccgggtacccctaaacccgttattttaaacgttgggtaacgcccggtaacgtaaccctagttacccggaaaccttaaaccggccctttaaccgaaaaccggtttttcccggaaaacggggggtccccgaaacggggggtaaacccccg

SEQ ID NO: 366822 - DNA, 625 bp, Homo sapiens
  misc_feature: GZ8MTXP02GTFT1.10.38.D05.1.454.CMB.2.raw
  modified_base (307)..(307): a, c, t, g, unknown or other
  modified_base (587)..(587): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctctgggttcagcatcaagtaacgactacatcgacctcggggccccnccgaggcctccggaggggaaggggcgtgggaggtgggtctcgtagttatagaaacagacgtggacactactattattattctgaccgttccggtaggtaacggggtcccggtttaccacccccttcgtcccaaggactaacctaccttacccaaacaactattctttagtacttcttacaccgtatcgacaactaagttccgaggaagtacggtaccgaaaccggacctaccgggcccttaaccttatttacgttgcgccgagaccattcggaactaacncttactaacgtttcgggacggggacctagggggacccc

SEQ ID NO: 366823 - DNA, 536 bp, Homo sapiens
  misc_feature: GZ8MTXP02FJV0S.10.38.D05.1.454.CMB.2.raw
  modified_base (298)..(298): a, c, t, g, unknown or other
  modified_base (357)..(357): a, c, t, g, unknown or other
  modified_base (368)..(368): a, c, t, g, unknown or other
  modified_base (401)..(401): a, c, t, g, unknown or other
  modified_base (407)..(407): a, c, t, g, unknown or other
  modified_base (419)..(419): a, c, t, g, unknown or other
  modified_base (440)..(440): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttccttgttgctatttacaaaaggtgtccactgtgaggttcaactggtggagactgggaggaggctgggatccagccgtggggggtcccctgagactctcctgtgcagcctctgggttcagcatcagtaacgactacatgaccngggccccgccaggctccgaggggaaggggctgggagtggggtctcgagttatagaaacngatggcatacntattatctgactcgtgaaggtccgttcaccctnccagancactcaacactntacttgtatctactacactcncacaactatagtagagtacgacgaaccgacgaccgacctaacttattgttgcgcgacaactgactaacgctactaatacgtcgggccgaggaccgg

SEQ ID NO: 366824 - DNA, 521 bp, Homo sapiens
  misc_feature: GZ8MTXP02I5J5N.10.38.D05.1.454.CMB.2.raw
  modified_base (220)..(220): a, c, t, g, unknown or other
  modified_base (266)..(266): a, c, t, g, unknown or other
  modified_base (354)..(354): a, c, t, g, unknown or other
  modified_base (384)..(384): a, c, t, g, unknown or other
  modified_base (490)..(490): a, c, t, g, unknown or other
  modified_base (521)..(521): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccaggggaaggggctggagtgggtctcagttattgaaacngatggcactacatattatctgactccgtgaagggccgttcaccctntccagagacacttccaaacaacatcttgatcttcacatgcacaaatctgagagtcggcgacacggccaaccctattatgtgcgcgacntgactacgctcaaattctggggccagggancccaggtcaccgtctcccccagcctccaccaagggcccagtcggtccttcccccgtggccgacccctgcctccaggacgcaacctccgagagcaacagcggcccgnggctgcctggacaacgactactccactactn

SEQ ID NO: 366825 - DNA, 574 bp, Homo sapiens
  misc_feature: GZ8MTXP02JIWSQ.10.38.D05.1.454.CMB.2.raw
  modified_base (302)..(302): a, c, t, g, unknown or other
  modified_base (355)..(355): a, c, t, g, unknown or other
  modified_base (472)..(472): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctcgggccccnccaggctccgaggggaaggggctgggagtcggggtctcgtagttattgaaacngaactggcatacatattatctgactcgtagaacgggccgttacaccctctccagacgaccacttacccaaacaacacttccttagtacttccttacacgtattcgacaacaagttcngaagcgtacgacgacaccggaccaccttaattgtgtacgcgacgacctatcggacctaacgacctacgtaacgttccggtacgggggcccaggggtaccccg

SEQ ID NO: 366826 - DNA, 614 bp, Homo sapiens
  misc_feature: GZ8MTXP02FZ3MX.10.38.D05.1.454.CMB.2.raw
  modified_base (255)..(255): a, c, t, g, unknown or other
  modified_base (271)..(271): a, c, t, g, unknown or other
  modified_base (359)..(359): a, c, t, g, unknown or other
  modified_base (562)..(562): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactggaggaggctggatccagccgtgggggtcctgagctctcctgtgcngcctcgtggtcagcancaagtaacgactacatcgaccgtcggccccgcgaggcctaccgaggggaacgggcgtgggaggtcgggtctgtacgttagtagaaacngagtggaccaatactattacttaattcgtacgtacgtcggtacgaccggggtcccgttaccacccttcgtaccaaggacaacctacccttaacccaaacgacctatttcttagtaacttccttacaactagtcacctaataatcctaggaccgagtcccgaacaaccgtacgcctacttaattacgtgacgcgaacacgtacncgtaacctaacggcttaacgtacgttcggacggggaccgacggggtaccccg

SEQ ID NO: 366827 - DNA, 933 bp, Homo sapiens
  misc_feature: GZ8MTXP02GEEKO.10.38.D05.1.454.CMB.2.raw
  modified_base (173)..(173): a, c, t, g, unknown or other
  modified_base (222)..(222): a, c, t, g, unknown or other
  modified_base (242)..(242): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccnccaggctccgaggggaagggctgggagtgggtctcagttattagaaacngatggcactacatattatcngactcgtagaacgggccgttcaccctctccagacgacctaccttaccaaacaactattcttagtacttcttacaactatcgaccaactaaattccgtaggaacggtacggttacccgaaaccggtaaccgaaccccggggtacccctaaacccccgtttaagtttttaacgtttacgggttaccgggacccgggtaacccggtaaaacctacggtttaaccggtaaaaccccgtttaaaccccggggtacccttttaaacccgttaaaaacgtttttcccgggggttaaccgggggggtaaccccgggtaaacggggggaacccggtaccccccgggtaaaacgggggttcccccgtaaacccccggggtttccccctacccccccggaaccggtacccccccgttaacccccgaaaacccccggaaaacccgggggccccccttaaaccgggttcccccgggtttaccccccgtttcccccccggtacggggtccccccggtcccccgttaacccggccccgttacccgggaacggggtacccgacccctaaccccggtacccgggaacggaccgaccgaaccggaccgggccccggggtccccggtacggggcccttcgggccccgtaagggtaaccctaaaacggggtaccccttaacccgtttccccaaaccgttaccgtttaacgg

SEQ ID NO: 366828 - DNA, 624 bp, Homo sapiens
  misc_feature: GZ8MTXP02JMM22.10.38.D05.1.454.CMB.2.raw
  modified_base (484)..(484): a, c, t, g, unknown or other
  modified_base (501)..(501): a, c, t, g, unknown or other
  modified_base (507)..(507): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctgggatccgagccgtgggggtcctgagactctcctgtgcagcctcgtgggttcagcatcagtaacgactacatcgaccgtcggccccgccaggcctccggaaggggaaggggcgtgggaggtcgggtctacgtaggtttaattaggaaaactaggacgtcggacaactactatatttacttcgtagtaccgttccgggtaggaaccggggtcccgttacccacccttccgtaccgaagacgaaccaccctttacccaaaatactnttccttagacttcttanacttanacacaatatcgagagtacgaccgaacgaccgaccgtacctacgtttaattcgtcgcgtaccgacactacgtcgaactccgtctaacgtacggtccgggacgggaccgaacggtcccg

SEQ ID NO: 366829 - DNA, 607 bp, Homo sapiens
  misc_feature: GZ8MTXP02GNRKC.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctctgggttcagcatcagtaacgactacatgacctggccccgccaggcctaccgaggggaaggggcgtgggagtgggtctcgtagttatagaaacagagtggacactactatatttattctgactccgtggaagggtcccggtcaccctctccaagtacgacctacttacccaaacaactattcttgtaacttcttacaacattcgaccaactaaacgttcctaggtagaacgtccgaaacgtaccgaccggaccctaaccctttacttaagtttggcggaccgtacgactaagtcgtaactaaccgtcttacgtaacgttccggcgggggacccagggggaaccccg

SEQ ID NO: 366830 - DNA, 645 bp, Homo sapiens
  misc_feature: GZ8MTXP02JU7BJ.10.38.D05.1.454.CMB.2.raw
  modified_base (466)..(466): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtgggggtccctgagactctcctgtgcagcctcgtgggttcagcatcaagtaacgactacatcgaccgtcgggccccgccgaggcctccgaaggggaaggggctgggaggtgggtctcgagttatagaaacagacgtggacacgtaactattatttattctgaccttccggtaggaacggggtcccggtttaccacccctctcccgaagacgaacctaccttaacccaaacaaccnttccttagtacttcttacactatcgacactaactcagacgacgtaccgaccgaccgaccggaccctaaccttaagtttacgttggtcggacccgacggaactacgtttacggaaccttaacggtaccttaaccgtaaacggtttccggtaccgggggacccgtaacgggggaaccccgg

SEQ ID NO: 366831 - DNA, 655 bp, Homo sapiens
  misc_feature: GZ8MTXP02H81L8.10.38.D05.1.454.CMB.2.raw
  modified_base (244)..(244): a, c, t, g, unknown or other
  modified_base (380)..(380): a, c, t, g, unknown or other
  modified_base (502)..(502): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactgggaggaggctggatccgaggccggtgggggtcccngagactctctgtcgcacgcctcgtggttcagcatacaagtaaccgactacagtcgacccgtcgggccccgaccgacggccgtaccggaaggggaaggggcgtaggggaggtgggtctacgtagttataagaaacgngagtcgactactactattattacttctacgtactccggtagggaaccgggtcccgtactaccctcgtaccagtacgacctacctacaaacactacttcgttatactctaccatactacgtanaacgacttcgaagaacgtacgtacgaacgaccgtaaccggtccctaaaaccttttattacgtttaggcgtacccggacgtaacctacgtcgtaaaacctcggtaccttaacccggaggtttccgggaccgggggaccaacggggtaaccccgg

SEQ ID NO: 366832 - DNA, 737 bp, Homo sapiens
  misc_feature: GZ8MTXP02G96FP.10.38.D05.1.454.CMB.2.raw
  modified_base (307)..(307): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtggaggaggctggatccaggccgtgggggtcctgagactctctgtgcagcctcgtggtcacgcatcaagtaacgactacatcgaccgtcgggccccncgaggccgtaccggaaggggaacggggcgtgggaggtcgggttctacgtagttattagaaacgtagagtgactacgtaactattactttagttcgtacgtacgttaccgggtacggaaacggggttccccgggttacccacccccgggtttaccacccggaaacggtaaccgtaaccctaaaccctttaccccaaaaacttaaaccttcgtttaccgtttagttaaaccccttcttaacctacttacgtaccgttaacccgaaacttaaacccgtacgttagaaacggttaacggtaccgaaaccgaccgtaacccgggaccttaaaccgtttaacggtttagttcggtacgacccgacgtaactacgtaccgaacgttccccggattaaccggacgtttacggggccggggacggaaacggggtacccg

SEQ ID NO: 366833 - DNA, 566 bp, Homo sapiens
  misc_feature: GZ8MTXP02HXOJS.10.38.D05.1.454.CMB.2.raw
  modified_base (302)..(302): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcaagtaacgactacatgacctgggccccncaggctccgaggggaaggggctgggagtgggtctcgtagttatagaaacagatggacactacatatttattctgactccggtagaacggggtcccgttacaccctctaccagacgacaccttaccaaacaactatcttagtactcttacactatcacaactaagtctagagagtacgacgaccgacgccctaacgttatttacgtgtcgacgacgaccatcgaacttaaccgctactaacgttcgacgggggaccaggggaccg

SEQ ID NO: 366834 - DNA, 619 bp, Homo sapiens
  misc_feature: GZ8MTXP02FP6RU.10.38.D05.1.454.CMB.2.raw
  modified_base (305)..(305): a, c, t, g, unknown or other
  modified_base (355)..(355): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatcgacctcgggccccncgaggctccgaggggaggggctgggagtgggtctcgtagttatagaaacngactggacctactactatatttactcgtgaccgttcgtagaacggggtcccgtcaccccgtctaccgaagacgaacctaccttacccaaacactacttacttagtacttcttacacctatacgactaacctaatccgtagaacgacggtaccggaacgacccgaccgggaccctaaccctttaagttacgtttggtacgcgaccgtacgacttcgaaaccgtccgtacctactaacgtttcgcggggacccgaggggaaccccg

SEQ ID NO: 366835 - DNA, 595 bp, Homo sapiens
  misc_feature: GZ8MTXP02I6IH3.10.38.D05.1.454.CMB.2.raw
  modified_base (171)..(171): a, c, t, g, unknown or other
  modified_base (260)..(260): a, c, t, g, unknown or other
  modified_base (273)..(273): a, c, t, g, unknown or other
  modified_base (275)..(275): a, c, t, g, unknown or other
  modified_base (277)..(277): a, c, t, g, unknown or other
  modified_base (289)..(289): a, c, t, g, unknown or other
  modified_base (319)..(319): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcgtggtttcgtgtaggctattanaaaggtgtccatgtgaggttcaacgtggtggagactggaggaggctgggatccgagccgtgggggtccctggacgctctcctgtcgacncgtcgtcgtgtcngnanacagtacactanagtcgcgtcggccgcgcgcgcgagggaggngtggtggtggtcgtagtagtagtagaagagacgtcgactactatattattattcgtacgtacgtacggtacggtaccgggtaccgtaccgtaccctcctacgtacgtacgtaactacctaacctaactaactacttacttatacttactactactatactactactactacgtagacgacgacgacgacgacgtacgtacttacgttagttcgtcgacgactacgtacgtacgtacgtaacgtacgtacgtacgtacggtacggacggacggtacg

SEQ ID NO: 366836 - DNA, 654 bp, Homo sapiens
  misc_feature: GZ8MTXP02IZH4G.10.38.D05.1.454.CMB.2.raw
  modified_base (336)..(336): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggctggactccagccgtgggggtcctgagactctcctgtgcagcctgtgggttcagcatcaagtaacgactacatgacccgtcgggccccgccagggcctaccggaaggggaacggggtntagggagttcgggtctacgtagttaattagaaaacaggatcggcaacttaacaattacgtttaacttcgtagtacccgttacggtagggaaaccgggggttccgttacaaccccgtcctaccgtagaacgacctaacttacccaaaacactattacgtttagtactaccttacaactattacgactaaccaattcctaaggacgtacgtccgaaacgaccgaacccggcttaaaacccttgttaacgtgttcggacgcgtaactactgaacctaacgtctacgtaaacttcggtacggggccgtaaaacggggccccg

SEQ ID NO: 366837 - DNA, 595 bp, Homo sapiens
  misc_feature: GZ8MTXP02GGIZK.10.38.D05.1.454.CMB.2.raw
  modified_base (457)..(457): a, c, t, g, unknown or other
tcagcatagtagtgcacgaccggtgctcgatttagtatctgataggttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacgactacatcgacctgggccccgcacggcctccgaggggaagggctgggagtgggtctcgtagttatagaaaacagacgtcggacactaactattacttattcgtagactccggtaggaacggggtcccgttcaaccctgtccaagacgtacctacttacccaaaacaaccttnttacgttatacttcttacactatcactaacatcgagaacgtacgacgaacacgtaccgtacctaacttagttacgtgacgcgacgactacgtacgaacgtaacgactaacgtacgttcggacgggaccgtacggaccg

SEQ ID NO: 366838 - DNA, 565 bp, Homo sapiens
  misc_feature: GZ8MTXP02HMX6F.10.38.D05.1.454.CMB.2.raw
  modified_base (281)..(281): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggttttcctgttgctattacaaaaggtgtccatgtgaggttcaactggtggagactggaggaggctggatccgagccgtgggggtccctgagctctcctgtgcagcctcgtggtcagcatcagtacactanatcgacctggccccgcaggctaccgaggggaagggcgtgggagtgggtcctgtagttatagaaacagatgactactactattattatctacgtacgtccgtaggacgggtcccgtcctaccctcaccgagaactacctacttaccaacaaccttcttacgttatacttcctacactagtcgacatacgtcgagacgacgtaccgaacgtaccgaccgtactacttatgtcgcgcgtacactcgtagacctaacgactacgttacgtcggacggaccgacggccg

SEQ ID NO: 366839 - DNA, 616 bp, Homo sapiens
  misc_feature: GZ8MTXP02FE6DM.10.38.D05.1.454.CMB.2.raw
  modified_base (454)..(454): a, c, t, g, unknown or other
  modified_base (468)..(468): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttagctatttcaaaaaggtgtccactgtgaggttcaactggtggagactggaggaggctgggatccagccgtggggggtcccctgagactctcctgtgcacgcctcgtggggttcagcatcaagtaacgactacatcgaccgtgggccccgccagggcctaccgaggggaaggggctgggagtgggtctcgtagtttatgaaacagatggcactacattattattctgactcggtagaacgggtccgttcaccctctccgaagacgactaccttaccaaacaactatccgtttntacttctacactancgacaactagtcgagacgtacggtaccgaaccgaccgtaccgtaccctaaacctttagtttacgttggtcggaccggaccgaacgtacgtacgtaacctaacgtacttaccgtacgttacgggtaccggggtaccggacggggacccg

SEQ ID NO: 366840 - DNA, 596 bp, Homo sapiens
  misc_feature: GZ8MTXP02IBD9L.10.38.D05.1.454.CMB.2.raw
  modified_base (457)..(457): a, c, t, g, unknown or other
  modified_base (477)..(477): a, c, t, g, unknown or other
  modified_base (537)..(537): a, c, t, g, unknown or other
  modified_base (549)..(549): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggtttcaactggtggagactggaggaggctggatccagccgtgggggtccctgagactctcctgtgcagcctcgtggttcagcatcagtaacgactacatcgaccgtcgggccccgccgagggcctaccgaaggggaacgggggctggggaggtggggtcttacgagttagttagaaacagacgtggacactacattattacttctgtactccgtaggaacgggtcccgttaccacccgtctacccaggacgacacttaccaaacactnttctagtactccttacgacntcgacaactatctgaagacgtaccgaacgaccacggaccctaacttagttacttcggacnccggtacaaacnttacgaaccttaacgctactaacgttcggacgggccgaaagggcccg

SEQ ID NO: 366841 - DNA, 661 bp, Homo sapiens
  misc_feature: GZ8MTXP02GUDJN.10.38.D05.1.454.CMB.2.raw
  modified_base (633)..(633): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtcccgagactctcctgtgcagcctcgtgggtcagcatcaagtaacgactaacatcggaccgtcgggccccgccgaggcctacccggagggggaacggggcgtgggaggtcggggtctacgtaggtttattacgaaaacgagatcgggacaactaacgattaattacttcgtacgtaccgtccggtagggtaaacggggtccccgttaccaccccttctacccgaagaccgaacctaaccttacccaaaactactattccttgtaactccttcaaactgtacactaaacacttcgtaggaacgtaggtaccgaacgaaccgacccggtacctaacgtattttacgtgtcgaccgtaccgaatacgtaccggaactacgtctaaccgtaagtttccgggnggggaccctaagggggaccctaccccgg

SEQ ID NO: 366842 - DNA, 761 bp, Homo sapiens
  misc_feature: GZ8MTXP02IG7DO.10.38.D05.1.454.CMB.2.raw
  modified_base (404)..(404): a, c, t, g, unknown or other
  modified_base (471)..(471): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcacgcctccctccgcgttccgggtctcctggacagtcagtcaccatcctctgcacgtgaaccagcagtgtactttgtgtacttaataactatcgtctcctaggtaccagccaccaccaggaccaaaccgcccctaaactttcctttgttttagacgtcaagtaacgccggtcctagacggacgttcctagtacttccggttctcgtcccgtcctaccgaagttcgtaggaccaaccnccgggtccctcccgtccggtacccgttccgttcggtcggtccctaccgacggtacgtaggtaacggngttacgggacggtcgtagtaactttaccacgtcgaccgtaacggccgtacttaacgttaccgttaccggacccggtaacccccgtaaagggttacggggttttcgggtttcgggggaaccgggttaccgggtaacggttaaaaccggggttccggaaccccggtttccggtacgggtaccgaacccggtacccggtaaaccggttccccgtccccggtaaccccccggtttggtaaccccttaccgttccccgtttaccccggtttaacccccctacccccgtttacccc

SEQ ID NO: 366843 - DNA, 650 bp, Homo sapiens
  misc_feature: GZ8MTXP02ION4U.10.38.D05.1.454.CMB.2.raw
  modified_base (519)..(519): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccgagccgtcgggggtcctgagactctcctgtgcacgcctcgtggttcagcatcaagtaacgactacatcgaccgtcggccccgccacggcctaccggaggggaacggggcgtgggaggttcggggtctcgtaaggtttattaggaaaacgagtagtcggacctaactactattatttacttctagtacgtccggtaggaaccggggtccgtccacccgtctacgaagacgaacctaccttaacccaaaacaactcttacttctactccttacactatcgtacaaactacttacgnggtaagtacggacgtaaccgaacccgaccggtacccctaaacgtttattacgtttggaccgcggaacctactacgtacgaccgttaacgacttaccacgtttccggaccgggggcccgaaaggggtccccg

SEQ ID NO: 366844 - DNA, 535 bp, Homo sapiens
  misc_feature: GZ8MTXP02GLSU3.10.38.D05.1.454.CMB.2.raw
  modified_base (350)..(350): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtggggtctcagttatgaaacngatggcactacatattatctgactccgtgaacgggccgttcaccctctccagacgacacttcccaaacaacatcttgtatcttacacatgcacaatctagagagtcgacgacacggccaaccttattattgtcgcgcgacacttgaacctaacgctacaacttcgtacgggggcccaggggaccg

SEQ ID NO: 366845 - DNA, 586 bp, Homo sapiens
  misc_feature: GZ8MTXP02F37UG.10.38.D05.1.454.CMB.2.raw
  modified_base (323)..(323): a, c, t, g, unknown or other
  modified_base (408)..(408): a, c, t, g, unknown or other
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctctggtaccagcaccacccaggacaaacgcccccaaactcctttgttttgagtcagtaagcgcctnagcgtccctgactcggttctctcgcctccaagtctggcaacgccggccctccctgacccgtctcgtcgggcctccgagctgaggntgaggctagtattactactgtacacgcgctaattattaccgaacggacccccaaagtacggggttggtttcgggacgggtacgggtaacgtaaagggtcggtaccggtaccgtcgggtacacggcccgaacggcctaccgcccccgtcgtccacctccgtcgtccccgcccttacccg

SEQ ID NO: 366846 - DNA, 637 bp, Homo sapiens
  misc_feature: GZ8MTXP02I2F49.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgagccgtgggggtccctgagactctcctgtgcagcctcgtgggttcagcatcaagtaacgactacatcgaccgtcggccccgcgacggcctaccggaaggggaacggggcgtaggggaggttcggggtctacgtagtttattacgaaaacgagagtcggacctaactactattagtttacttcgtagtaccttccgggtaggaaccggggtcccgttaccacccctcacgaagacgacctaaccttaccaaactaactattcgttataacttccttaacacctagttacgaccaactaacttcgaggacgtacgtacgaaccgacgaccgacctaacttattacgttcgcggtacgacgactacgtcgaactcgactactaacggttcggtcggggaccgtacggtacccg

SEQ ID NO: 366847 - DNA, 746 bp, Homo sapiens
  misc_feature: GZ8MTXP02HL51I.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggcgtggatccgagccgtgggggtccctgagtactctcctgtcgcagcctcgtggttcagcatcaagtaacgactacagtcgaccgtcgggccccgcgacggcctccggaaggggaaggggcgtacgggaggttcggggttacctacgttaaggttaagttagaaaacgtagaacgtacggactaacgtaactattaactttattccgtacgtaccgttccggttacggtaaaccggggtccccggtttacctaacccccgtctaacccgaaggtaaccgacctaaaccctttaacccaaaacctaaccttacttaccgtttacgttaacttccgtttaccaaaccgtataacgtaaccaacctaaagttccgtagggtaaacgtacgtaacccggaaaccggacccgaaccggtaccctaaccgtttaatttacggttcggtacgaccggtaacgaccgtagttaaccgtaccgtaaccgtccgttaacgtaccgtttacgggaccggggaccggtaacggggaccccgg

SEQ ID NO: 366848 - DNA, 589 bp, Homo sapiens
  misc_feature: GZ8MTXP02IWNZL.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctcgtgggttcagcatcaagtaacgactacatcgaccgtcgggcccgccaggctccgaggggaacgggctggagtgggtctctagttatagaaacagagtggacactactattattactctcgacgtccgtagaacgggtccgttacaccctctacgagacacctacttacccaaaactactattcgttatactcttaccaatatcgaacaacattcagtacgacggtcgaacgacaccggacctaaccttattacgttggacgcggacacgtaacgtcggaacctaacgcttacgtaaacgttccggacggggacctagggggaacccc

SEQ ID NO: 366849 - DNA, 624 bp, Homo sapiens
  misc_feature: GZ8MTXP02JU3UV.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgaccgtcgggccccgccgaggcctccggaggggaaggggctggggagtggggtctcgtagttatagaaacagatggcactacattattattctgactcggtagaacgggtccgttccaccctctaccgagacgacctaccttacccaaacaacctattccttagtacttccttacacctatcgacaactaattcgagaagtacgtacccggaacgacccgaccggtacccctaacctttaatttacgtttcggtcggaccggtaccggaacctagttccggaacctaacggtccttacgtaacgtttccggacgggggacccaagggggaccccg

SEQ ID NO: 366850 - DNA, 599 bp, Homo sapiens
  misc_feature: GZ8MTXP02GPWFY.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtcctgagactctcctgtgcagcctgtgggttcagcatcagtaacgactacatcgaccgtcggcccgcaggctccggaggggaagggcgtggagtggtctcgtagttatagaaacagatcgacactactattattatctagacgtcgtaggaacgggtccgttaccacccgtctacccgagacgtacctaaccttacccaaaacaactacttcgttagtactccttacgaactatcgacaactaatctacggagacgtaccgaacgacctaccgacctaacttattacgttggacgaccgacaactctacgaacctaacgccttaaacgtacgttccggacgggggacccaagggggtaccccg

SEQ ID NO: 366851 - DNA, 615 bp, Homo sapiens
  misc_feature: GZ8MTXP02HBY1C.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtgggggtccctgagactctcctgtgcacgcctcgtggtcagcatcagtaacgactacagtgaccgtcgggccccgccacgggctaccggaaggggaacggggcgtgggaggtggggtctcgtagttaagttagaaacgtagacgtcggactactatacttaagttacttctacgtaccgtacggtaggtaaccggggtcccggttaccaacccctctacccgaagtaaccgaacctaccttaaccaaactaaacctgttccttagtacttcttacacaattcgacaactatctagagacgtacacgaccgcgaccacttattacgtgtacgcgacgacacgtcaactcgtcgactaacggttcggcggggaccgacggggtaccc

SEQ ID NO: 366852 - DNA, 652 bp, Homo sapiens
  misc_feature: GZ8MTXP02J1TG9.10.38.D05.1.454.CMB.2.raw
  modified_base (261)..(261): a, c, t, g, unknown or other
  modified_base (295)..(295): a, c, t, g, unknown or other
  modified_base (321)..(321): a, c, t, g, unknown or other
  modified_base (369)..(369): a, c, t, g, unknown or other
  modified_base (399)..(399): a, c, t, g, unknown or other
  modified_base (431)..(431): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccatgtgaggttcaacgtggtggagacgtggaggaggctggatccgagccgtgggggtccctgacgactctcctggtancagtcctgtgggtcagcatcgaataacgactacngtcgaccgtcggccccgcgaggtccnccggaaggggagggtctaggggagtcgggtctgtaaggttatagaaanagagtcgacaactactagtattacttccgngaacgtcgaggaacggggtccttccacccgtnagaactacaactacctaccaaaatccctagggtttactatacccttactaaccggatactacacaactaacgtacgtacgtaacggtacggtaaccgaaccgaaccgtaacccgtaaccgtaacttaacgttacgttacggtacggtacgaccgtacgtaacgtaacgtaaccgtaaccgtacgtacgtacggtaccggtaccgggtaccgggacggaccg

SEQ ID NO: 366853 - DNA, 698 bp, Homo sapiens
  misc_feature: GZ8MTXP02JI2J1.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcagtaaccgactacatcgacccgtcgggccccgccgaggcctccggaaggggaaggggctgggagtggggtctcgtagttatagaaacgagacgtggacctactacgtattattattcgtacgaccgttccggtagggtaaaccggggtcccggtttaccgaacccccttccgtacccgaaacggtaacgaaccccttacctttaaccccaaaacctaaactatttacctttgtaaacttcctttacaaactatacgaccaactaaacttcgagtaaacgcgtacccggaaacgacccgaacccgggtcctaaccctttaaagtttacggttcgggtaccgaccgggttacaacgtaacgtaccgaaccgttaaccgccttaacgtaaacggtttccggacgggggacccgacggggtaccccg

SEQ ID NO: 366854 - DNA, 707 bp, Homo sapiens
  misc_feature: GZ8MTXP02FPQFL.10.38.D05.1.454.CMB.2.raw
  modified_base (369)..(369): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagacgtgggaggaggctggatccaggccgtgggggtccctgacgactctcctgtgcagcctcgtgggttcagcatcaagtaacgactacatcgaccgtcgggccccgccacgggcctccggaaggggaacggggctggggagtggggtctcgtagtttatagaaacnggactcggacactaactattaatttacttcgtacgtaccgttaccgggtaggtaaccgggggtcccgtttacccgaccccttccgtaccgaggtacgaaccctaccttaacccaaaacaccttagtttcctttacgtaaacttccttacaactactacgacctaaacaagttccgaagaacggtaccggtacggaaccgtaccgaacccgggtacccttaaaccgttagtttacgttcggacggtccgacgtaacgttacgtaccggtaacccgtaacgtccttaaacgttaaccggtttccggggaacgggggaccccgtaacgggggtaacccccg

SEQ ID NO: 366855 - DNA, 603 bp, Homo sapiens
  misc_feature: GZ8MTXP02FZU0Z.10.38.D05.1.454.CMB.2.raw
  modified_base (462)..(462): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctcctgtgcagcctcgtgggttcagcatcagtaacgactacatcgaccgtcgggccccgccaggcctccgaggggaaggggctgggagtgggtctcgtagttatagaaacagactgacactacattattattctgactcgtagacggggtccgttccacccgtctccgagacgactaccttaccaaacactattcttagtactccttacaactntacgacactaatgtagacgtacgtaccgaacgaccaccggtacctaaccgttatttacgttgtacggtccgaccgtaactcgtacgtaacctccgtacttaccgtaacgtttccggacgggggacccgtaggggaaccccg

SEQ ID NO: 366856 - DNA, 677 bp, Homo sapiens
  misc_feature: GZ8MTXP02IT5RK.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtcctgcgactctcctgtgcacgcctcgtgggttcagcatcaacgtaacgacctaactactcgaccccgtcgggccccgaccgaagggtcctaccggaaggggaacggggcgtaggggtagtcggggtctccgttaaggttaagttagaaacaggtacgtggtacctaacttaactaattactttacgttccgtagtacccgttccggtacgggtaaccggggtccggtttccctaccccgttctaccgtaagtaacgacctaacccttaccaaaactaacctactttcgttataccttctttaacaaccgtatacgtaccaaacttagtacgtagagtacgtaccgaacgacccgtacgccctaacttagttacgttgcgacgacgtaccgtatcgaccgtaacgaccttactaacggtcgtacgggcgaacgggtaccg

SEQ ID NO: 366857 - DNA, 655 bp, Homo sapiens
  misc_feature: GZ8MTXP02GOFRA.10.38.D05.1.454.CMB.2.raw
  modified_base (281)..(281): a, c, t, g, unknown or other
  modified_base (298)..(298): a, c, t, g, unknown or other
  modified_base (403)..(403): a, c, t, g, unknown or other
  modified_base (555)..(555): a, c, t, g, unknown or other
tcagcatagtagtgcacgaccggtgctcgatttagtatctgatagttgggtttgggctgtgaggttcaactggtggagactggaggaggctggatccagcctggggggtccctgagactctcctgtgcagcctctgggttcagcatcagtaacgactacatgacctgggcccgccaggctccgaggggaagggctggagtgggtctcagttattagaaacagatggcactacattattattctgactccgtggaacggggtcccgttcaccctcaccaganaccacttccaaacaacntcttgtattctcacatgacacaatctagagtcgtacgaacgaccaccggccaacccttattattcgtcgcgacgactagtcgactacgcctagtaacgtttcggngggggacccgaggggaccgcccgtaacgggtccctaaccccggttccctcccccgacgtcccccgtacccgaaccccggtaacggggccccctacggttcccggttcccctttccccccgcggcccgtacccctcgtccgaccgacggaccnccgaaccctcggaacgacgccgaaccgcggcccggtccgtcggggcctacggccgttaacggaccgaaacggtccctaccgttacccaacttaccgtacg

SEQ ID NO: 366858 - DNA, 594 bp, Homo sapiens
  misc_feature: GZ8MTXP02FKHYV.10.38.D05.1.454.CMB.2.raw
  modified_base (364)..(364): a, c, t, g, unknown or other
  modified_base (389)..(389): a, c, t, g, unknown or other
  modified_base (549)..(549): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtgggttcagcatcagtaacgactacatcgaccgtcgggccccgccgaggccctaccgaggggaaggggctgggaggtcggggtctcgtagttatagaaaacngatcggacactacattattattcgngactccggtagaacgggtcccggttccaacccttctccgagacgacctaccttaccaaacactatcttgtactcttacgactatcgaccaactaacgtctagacgtacgtccgaacgtacaccggcccaacgttattagttcggcgtccgacgtactacncgtacctaacgtcttacaacgtttcgcggggaccgagggtacccg

SEQ ID NO: 366859 - DNA, 621 bp, Homo sapiens
  misc_feature: GZ8MTXP02G9EOK.10.38.D05.1.454.CMB.2.raw
  modified_base (367)..(367): a, c, t, g, unknown or other
  modified_base (463)..(463): a, c, t, g, unknown or other
  modified_base (554)..(554): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctcgtggtcagcatcagtaacgactacatcgaccgtcgggccccgccgacggcctaccggaaggggaaggggcgtgggaggtgggtctacgtagttaattagaaaacngagtggactactaactattaattattctacgtacttccggtaggtaacggggtcccgttaccaccctctaccaaggaacactaacttacccaaaanaacctattctatactctacaagtatcacaactaagtcctagacggacgtaccgaacgtaaccgaccgtacctaacctttaacttacgtttncggacgacgaactatcgtaactaaccgacttaacgaacgttcggacgggggacccgaagggaccccg

SEQ ID NO: 366860 - DNA, 625 bp, Homo sapiens
  misc_feature: GZ8MTXP02FSG9R.10.38.D05.1.454.CMB.2.raw
  modified_base (389)..(389): a, c, t, g, unknown or other
  modified_base (517)..(517): a, c, t, g, unknown or other
  modified_base (567)..(567): a, c, t, g, unknown or other
tcagcatagtagtgcacgaccggtgctcgatttagtatctgatagttgggtttggggtacgatttgatgttacctgatgcttagaggcttttcctggaagcagggcatttgttgcttcagcaccgtagtgcctcgtcatcacgcctcagccttgtattttccggatttgcctaggaaaaccagcctacacgcttaaaccgggacaaccgtcgcccggccaacatacgccttctcccgtccccccttcgcagtaacaccaagtacagaatattaacctgttccatcgactacgcctttcggctcgccgtagggtcactcaccctgccccgtattacgtgacacggaccttggtctcggcgagcggtctttccgcctgttactccttactntgtcagctattcgactacttctacgactaccgtccagcatcgcctacaactcgacacgtactcacacgtcttaaacgacgtaaacccgcctaccccctaaccaaccaacgaccaaagtacgtcgaccncgtcgccgacgtacgtcgttcggtctaccgtacggtttccggtttaaccnccccgttaactaacgttcccgtacccggaccgtaccggaccggtcccgtaccgtaccg

SEQ ID NO: 366861 - DNA, 561 bp, Homo sapiens
  misc_feature: GZ8MTXP02HZ8GE.10.38.D05.1.454.CMB.2.raw
  modified_base (248)..(248): a, c, t, g, unknown or other
  modified_base (258)..(258): a, c, t, g, unknown or other
  modified_base (297)..(297): a, c, t, g, unknown or other
  modified_base (317)..(317): a, c, t, g, unknown or other
  modified_base (328)..(328): a, c, t, g, unknown or other
  modified_base (341)..(341): a, c, t, g, unknown or other
  modified_base (352)..(352): a, c, t, g, unknown or other
  modified_base (361)..(361): a, c, t, g, unknown or other
  modified_base (390)..(390): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggagctggatccagccgtgggggtccctgagactctccngtgcagcctntgggtcagcatcagtaacgactacatgacctgggccccncaggctccgaggggaaggcnggatgggtctnagttatacgaaangatgacactanatattatcngtactccgtagacggtccgtcaccccgtnacgagacactaactaccaaatactcgttctatactctaacgatactacacactacgtacgtagacgacgacgacgaaccgaccgaccgtaactacgttacgtacgtacgacgacgacgtacgtaacgtacgtaacgtacgtacgtacgtacggtacggtacggacggaccg

SEQ ID NO: 366862 - DNA, 722 bp, Homo sapiens
  misc_feature: GZ8MTXP02F06UD.10.38.D05.1.454.CMB.2.raw
  modified_base (248)..(248): a, c, t, g, unknown or other
tcagcatagtagtgcacgaccggtgctcgatttagtatctgatagttgggttttccttgttgctatttcaaaaggtgtccactgtgaggttcaactggtggagactgggaggaggctggatccagccgtggggggtccctgagactctcctgtgcagcctctgggttcagcatcagtaacgactacatgacctcgggcccgccaggctccgaggggacgggctggagtgggtctctagttatgaaacngatggacactacattattattctgacctcggtaggaaccgggtcccggttaccaccccgtctccgaagacgacctaaccttacccaaactaactacttcttagtattccttacactatcgaccaactaatccgtagaaggtacgtaccggaaaccgaccaacccggtaccctacttaacgtttagttcggacggaccacggtaaactacgtaacgtaacctacggtacctaacgttaacgtttccggggacgggggaccgaacgggggtccaccccgggtacggtccctacccggttcccctacccccggtaccgtacccctaccccgaaacccggtaccgggacccctacggtttcccgtcccccgtttcccggcggaccctccgtcggacctccgaggcctaccgaccgtccgaacgcgaacccgaacggaccgggtcccggaccggtacgggcctccggtccgttaacggg

SEQ ID NO: 366863 - DNA, 789 bp, Homo sapiens
  misc_feature: GZ8MTXP02HQ3XK.10.38.D05.1.454.CMB.2.raw
  modified_base (309)..(309): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccaggccgtgggggtccctggagactctcctgtgcagcctgtgggtcagcatcaacgtaacgactacatcggaccctcggggccccnccgacgggcctccggaagggggaacggggcgtaggggaggttcggggtctacgtaagtttaagttaaggaaaactaggagttacgggacctaacgtaactaatttaactttaactttccgttacggtaacccgtttcccgggtaaggggtaaacccgggggtcccccggtttacccctaaccccccgtttcgtaaccccgaaaggtaacccgtaaacccttaacccgttaaacccccaaaaactaaaccttacgtttacccctttaagttaacttccctttaccaaaccttaagttccggaaccaaaacgttaactttaccggtagggaaaacggacccggttaaccggaaacccgaacccgtaaccccgggtaccctaaaccctttaagtttacgttggaccgtaccggacgtaaacctagtacccgtaactaacggtccctaacgtaagttcccgggacggggaccccgagggggacc

SEQ ID NO: 366864 - DNA, 681 bp, Homo sapiens
  misc_feature: GZ8MTXP02I396J.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcacgcctcgtgggttcagcatacacgtaacgactacagtcggaccgtcgggccccgccagggcctccggaaggggaacggggcgtgggaggttgggtcttacgtaggtttattaggaaaactgacgtcggactacgtaactattaacttattcgtacgtaccgtccgggtacgtaccggggtacccggttccaaccccttcgtaccacggaacacctaaccttacccaaactaactcttcgtttactacctctttaccaactactacacctaactaacttccgtaaggacgtacgaccggaacgaccaccggtacctaaacctttacttaggttcggtcgaccgtacgtaccgtaacgttcggaaaacccttcggtaccctaacgtaaccggtttccgggcggggacccggtaaaacgggcccccgg

SEQ ID NO: 366865 - DNA, 584 bp, Homo sapiens
  misc_feature: GZ8MTXP02G6WCS.10.38.D05.1.454.CMB.2.raw
  modified_base (359)..(359): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccaggccgtgggggtccctgagactctcctgtgcagcctgtcgggtcagcatcagtaacgactacatcgaccgtgggccccgcagggcctccggaaggggaaggggctggagtgggtctacagttaattagaaacngatggacactacatattatctgactccggagaacgggtcccggttccaccctcgtaccagacgacctacttaccaaaacactattaccttgtactcttacactatgaccaactaatctagaacgagtacgaacgactaccgacctaacccgttattaccgtttgcgccgtacgacctagtacgacctaacgctacgtaacgtttggcgggacccgagggaccccg

SEQ ID NO: 366866 - DNA, 672 bp, Homo sapiens
  misc_feature: GZ8MTXP02HWJFA.10.38.D05.1.454.CMB.2.raw
  modified_base (335)..(335): a, c, t, g, unknown or other
  modified_base (432)..(432): a, c, t, g, unknown or other
  modified_base (593)..(593): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccggtgggggtccctgacgactctcctgtcgcacgcctcgtggtcagcatcgaagtacgactacatcggcctcgggcccgcgacggctccggaaggggagggcgtgggngtgggtctacgtagttagttaacgaaacgagtacgtcggactaactactattattacttcgtagtactccgtaggtaccgggtccgttccacccgtntcccgagtaccgtactaacccttacccaaaactactacgttcttacgtactccttacacttgtcacctaagactcgtaggaacgtacgccggaaacaacccgaccggtacccctaacgtttagtttacgtacgttggaacccggtacaccggtttaaaacncggtaaaccccgttaacggtccttaacgtaaaccgggtttccgggggacccggggtaccgggtaaacccggggtccccg

SEQ ID NO: 366867 - DNA, 727 bp, Homo sapiens
  misc_feature: GZ8MTXP02JZGMV.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtgggaggaggctggactccgaggccgtcgggggtccctgagactcctcctgtgcacgtcctcgtgggttcagcatacaagtaacgactaacatcgaccgtcgggccccgccgacggccgtaccggaggggaacggggtcgtaggggtaggttcggggttcctacggtaagtttaagttaacggaaaacgaggtacgtacggactaaccgtaactattactttactttcgtagtacccgttaccgggtaggtaaccgggggtccccggtttacctaacccccttccgttacccgaacggtaaccgaacccttaacccttacccaaaactaaacctactttaccgtttatacttccttacaactatacgacaactaacttacgtagaacgtacggtacccgacgaaccgaccgtaccctaacctttaactttacgttcggtcgtaccgacgtaacgtacgtaccgaaccgtaaccgtacttaacgtacggtttcggaccggggaccggtacgggacccg

SEQ ID NO: 366868 - DNA, 695 bp, Homo sapiens
  misc_feature: GZ8MTXP02FOMVD.10.38.D05.1.454.CMB.2.raw
  modified_base (287)..(287): a, c, t, g, unknown or other
  modified_base (340)..(340): a, c, t, g, unknown or other
  modified_base (538)..(538): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcttggggtttttccttgttgtcttatttacaaaaggtgtccactgtgaggttcaacgtgggtggagacgtgggagggaggctggactccgacggcccggttcggggggtccctggacgtaccttcctccgtggtgaccncgtcctcgttgggtcagcatcaagtacgactacactcgacccgtcgggccccncgacggccgtccggaagggggaacggggcgtgggaggtgggtctacgtagtttaatagaaaacgagacgtcgggacctaacttaactagtttaactttaatttccgtacgtacccgttaccgggtaaggggtaacccggggtcccggtttacccacccgtttccaccgaagaacctacctaacccttacaaacacttnttacttgtactacgttacacgtctagcctaaacagttcagagtacgcgaaaccgatacccgaccttaactagtttacgtcggcgaccgaccggtataacggtcaaaccgttcgtacttaccgtaacgtttccggggacggggacgaacggggacccg

SEQ ID NO: 366869 - DNA, 655 bp, Homo sapiens
  misc_feature: GZ8MTXP02HIKR7.10.38.D05.1.454.CMB.2.raw
  modified_base (518)..(518): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtggaggaggctggatccagccgtgggggtccctgagactctccgtgtgcagcctgtggttcagcatacagtaacgactacgatcgaccgtcgggccccgcgacgggcctaccggaggggaacggggcgtagggaggttacggggtcctacgtaggtttaagtaggaaactagacgtggactaactactaattagttattcgtacgtaacttccggtaggtaaccggggtcccgtacctacccctcgtaccgaaggtaccactacccttaacccaaacactattccgttatacttcttaacacttacncgtaacactacgtcgtaggacgtaccgacgaaccgaccgtacccgtaccttaacgtttagttcgtcggacgtaccgactacgtacgtaccgaactccgtactaaccgtacggttcgggaccgggaccgaacgggccc

SEQ ID NO: 366870 - DNA, 568 bp, Homo sapiens
  misc_feature: GZ8MTXP02FKH7E.10.38.D05.1.454.CMB.2.raw
  modified_base (350)..(350): a, c, t, g, unknown or other
  modified_base (372)..(372): a, c, t, g, unknown or other
  modified_base (400)..(400): a, c, t, g, unknown or other
  modified_base (465)..(465): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctggagactctcctgtgcagcctcgtgggttcagcatcagtaacgactacatgacctgggccccgcaggctccgaggggagggctggagtgggctcgtagttatgaaacngagtgacatacattattattcngactcgtgaacgggtccgttccaccctntccgaagtacgacctacttacccaaacaactattcttagtactcttacgacatcgacagaactcngagacgtccgaacgaccacggccctaacttattacttggcgcgacgaactactcggaacctaacggcttaacgaacgtttcggacgggggaccagggggaccc

SEQ ID NO: 366871 - DNA, 619 bp, Homo sapiens
  misc_feature: GZ8MTXP02JU50E.10.38.D05.1.454.CMB.2.raw
  modified_base (392)..(392): a, c, t, g, unknown or other
  modified_base (419)..(419): a, c, t, g, unknown or other
  modified_base (424)..(424): a, c, t, g, unknown or other
  modified_base (478)..(478): a, c, t, g, unknown or other
  modified_base (536)..(536): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccggtcgggggtccctgacgactctcctgtgcacgcctcgtggttcagcatcaagtaacgactacatcgaccgtcgggccccgcgacggcctccggaggggaacggggcgtggggaggtcggggtctcgtagttattagaaacgagacgtgacactactattattnttctgactcgtagaacggggtcctacnccctntacccaggacaacctaccttacaaacactattctagttactcttacacatcganaactactcgtagagtacgtcgaacgaccgaccgtacctaactttaagttcgttccggngacccggtacaccgtaacgttccaaaccgttcgtacctaaacgttacggtcccggtacgggggtaccgaacgggggtaccccg

SEQ ID NO: 366872 - DNA, 552 bp, Homo sapiens
  misc_feature: GZ8MTXP02I8RH2.10.38.D05.1.454.CMB.2.raw
  modified_base (304)..(304): a, c, t, g, unknown or other
  modified_base (402)..(402): a, c, t, g, unknown or other
  modified_base (439)..(439): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctattttcaaaaaggtgtccactgtgaggttcaactggtggagactggaggaggctggatccagcctggggggtccctgagactctcctgtgcagcctctgggttcagcatcagtaacgactacatgacctgggccccncaggctccgaggggaaggggctggagtgggtctcagttatgaaaacagatggcactacattattattctgtacgtccgtgaacgggtcgttcaccctntccagagacacttaccaaacaacattctatatcttanactatgactaacaatcgagagaagcgaacgaacacggccaaccttatactttgacgcgaccgaacactacgaactaacgactaacgtaacgttcggacgggaccgaacgggcg

SEQ ID NO: 366873 - DNA, 681 bp, Homo sapiens
  misc_feature: GZ8MTXP02F8DF0.10.38.D05.1.454.CMB.2.raw
  modified_base (522)..(522): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgacgccgtcgggggtccctgagactctcctgtgcacgtcctcgtggtcagcatcaagtaacgactacagtcgaccgtcggccccgccgacggcctaccggaggggaacggggcgtgggtaggtgggtctcgtagttattagaaacgagtacgtgactactactattatttacttcgtacgtaccgttccggtacgggtaaccgggtcccggtcctaccccttcctaccgaaggtaaccgaacctaccctttaacccaaaacgtactacttaccgtttgtacttccctttaacaacctnttacgacaaacgtaacgttacgtaggagtaaccggtaccgaaaccgaccgtaacccgaccccttaatttaagtttattcgggacgccggactaactacgtacgaaccgtaacgtccttaaagtacggtttcggggaccgggaccgtaaacggggccccg

SEQ ID NO: 366874 - DNA, 701 bp, Homo sapiens
  misc_feature: GZ8MTXP02JC7DV.10.38.D05.1.454.CMB.2.raw
  modified_base (643)..(643): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactgggtggagacgtggagggaggctggatccaggccggtcggggggtccctgacgactctcctgtgcacgcctcgttgggtcagcatacgaacgtaacgactacgactcggaccgtccgggccccgcgacgggtcctacccggaagggggaacggggcgtggggacggttcggggtctacgtaagtttaagttagaaaacgtagtacgtcggaccaacttactatttaatttattccgtacgtacccgttcccggtaagggtaacccgggggttcccggttaccctacccccggtttacaccccgtaaggaacccgaaaccctttaccttaacccaaaactaccctaagtttcctttaagtacccttcttaacccagtacttacgtacctaaacgtacttaccgagtagacggtaccgaccaaccgcgtaccctagtattacgttcncggcacgacagtaccgacgttaacgccctagtaacggtcgtcggggaccgaggggccc

SEQ ID NO: 366875 - DNA, 752 bp, Homo sapiens
  misc_feature: GZ8MTXP02JHD40.10.38.D05.1.454.CMB.2.raw
  modified_base (537)..(537): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggagggaggctggactccgaggccggtcgggggtccctgacgacctctcctgtgcagtcctcgtgggttcagcatacaagtaaccgactacagtcgtaccgtcgggccccgccagggccctaccggaaggggaacggggtcgtggggacggttcggggtcctacgttaagttagttaacgaaaacgaggacgtacggacctaactactaactttatttacttcgtacgtaccggttccgggtagggaacccggggttcccgttacccacccttccgtacgaacgtacgaaccctacctaacccaaaacgtaacctactttacgtttnttaaactcctttaacaaacgtacgttacacctaaacttaacgttacgaacggaacgtaccgtacccggaaaccggacccgtaaccggacccttaacgtttaacgtttacgttcggacgggaccggtaaccgtactaaacgttcccggaaacttaaccggtacttaaccgtacggtttcccgggaaccgggggtcccggaaacggggtacccccgg

SEQ ID NO: 366876 - DNA, 580 bp, Homo sapiens
  misc_feature: GZ8MTXP02JF222.10.38.D05.1.454.CMB.2.raw
  modified_base (330)..(330): a, c, t, g, unknown or other
  modified_base (338)..(338): a, c, t, g, unknown or other
  modified_base (461)..(461): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttcctgttgctatttcaaaaggtgtccactgtgaggtttcaactggtggagactggaggaggctgggatccagcctggggggtccctgagactctctgtgcagcctctgggttcagtcatcagtaacgctacatcgactcggcccacaggctcgagggaagggctggagtgggtcncgtagttntagaaacagaactggacactactataattctctgacttccgtgaacgggtccgttacacccttagtccaggacacacttaccaataccagttcctgactcttacactaggctcacgtaatcgngaagcgtcacacgacggcctaaccgttatacgtttggacgtcggaccgacgtaaaccttggtaccaaccggtcttactaaaacgtttcggtaccgggggacctaaacgggggacccccg

SEQ ID NO: 366877 - DNA, 676 bp, Homo sapiens
  misc_feature: GZ8MTXP02ILGCU.10.38.D05.1.454.CMB.2.raw
  modified_base (625)..(625): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggtttttccttgttgctattttcaaaaggtgtgcactgtgtaggttcaacgtgggtggagacgtgggaggaggctggactccgaggccggtcgggggtcctgagctctcctgtcgcacgtcctcgtcgggttcagcatacgaagtaaccgactaacactcgacccgtcgggccccgcgacggtcctacggaggggagggcgtggaggttgggtctacgtagttagtacgaacagtatcgactaactactattaacttcgttcgtacgtaccgttaccggtagggtaaccggggtcccggtttcccacccgttgaccctaaggaactaaccctacccttaaaccaaacctaacttactttacgtttactactttcgtaacctaactacggttccacttaaacaacgtttcgaaggtacgtaacgaccgaacgacgaccgtacctaactttagttacgtgcgaaccgacgtaactntaaccgtaacgtccacgttactacggtttccggacgggggtaacccacggg

SEQ ID NO: 366878 - DNA, 588 bp, Homo sapiens
  misc_feature: GZ8MTXP02FI8ST.10.38.D05.1.454.CMB.2.raw
  modified_base (356)..(356): a, c, t, g, unknown or other
  modified_base (375)..(375): a, c, t, g, unknown or other
  modified_base (434)..(434): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctcgggccccgccaggctccgaggggaaggggctgggagtgggtctcgtagttatagaaacngatgcatacatattattcngactcgtagaacgggtccgtccaccctctacagacgacaccttacaaacactaatcttntactcttacactatcgacaactaatctagaagacgtacgaccgaacgaccggtacccaaccgttaatttagttcggtcggaccgacggaacctagtacgaaccgtaaccgtccttactaaacgttcggtacgggggacccgacggggaaccccg

SEQ ID NO: 366879 - DNA, 689 bp, Homo sapiens
  misc_feature: GZ8MTXP02JCN79.10.38.D05.1.454.CMB.2.raw
  modified_base (298)..(298): a, c, t, g, unknown or other
  modified_base (544)..(544): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttgggttttccttgttgctatttacaaaaggtgtccactgtgaggttcaacgtggtggagacgtggaggaggctggatccgagccgtcgggggtcctggacgactctccgtgtgcagcctgtgggttcagcatcaagtaacgactaanagtacgaccgtcggccccgcgacggccgtaccggaaggggaacggggcgtgggaggttgggtctcgtaaggtttacttagaaacgtgaacgttcggactaaccgttactaatttaactttacttcgttacgaccggttaccgtacggtaccggggttacccggttaccaaccccttccgtacgtaacggaacgaaccctaaccgttaaccaaacaactacgttacttgtaactcgttaccaacgtntacgacaaacctaagttcccgtaggaagtaaccggtcggaaaccggactacccgggaacttaccgttagttaacgtcggtcgtaccgacgtacgacttcgaaacctcgtctaactacgttcggtaccggggacgacggtaacccg

SEQ ID NO: 366880 - DNA, 659 bp, Homo sapiens
  misc_feature: GZ8MTXP02F688J.10.38.D05.1.454.CMB.2.raw
  modified_base (416)..(416): a, c, t, g, unknown or other
  modified_base (469)..(469): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggactccgacgccgtgggggtccctgagtactctctgtcgcacgcctcgtgggttcagtcagtctaagtaacgactacatcggaccgtcgggccccgacacgggctccggaaggggaaggggtcgtcgggaggtcgggtctcgtagtttagtagaaacaggtactcggcctaacgtactaaatttactttattccgngtacccgttcgggtacgggtaaccgggggtcccggttaacctacccgttaccnccgaaacggtacaaacctaacccttaccaaaacctaactaacttcgttatactaccttacacctatcgtacaactaagtctacgagtacgcgaaccgacgaccgaccctaacttcgttaatcggacgacgacgtacacgtagacctaacggacttacgtaacggttcgacgggacccggaaggggtcccg

SEQ ID NO: 366881 - DNA, 601 bp, Homo sapiens
  misc_feature: GZ8MTXP02I0UQ5.10.38.D05.1.454.CMB.2.raw
  modified_base (305)..(305): a, c, t, g, unknown or other
  modified_base (359)..(359): a, c, t, g, unknown or other
  modified_base (461)..(461): a, c, t, g, unknown or other
  modified_base (475)..(475): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagacgtggaggaggctggatccagccgtgggggtccctgagactctcctgtgcagcctgtgggttcagcatcaagtaacgactacatcgaccgtcgggccccncgaggcctccgaaggggaagggctagggagtgggtctacgtagttatagaaacngatgacactacattattacttcgtagaccttccggtacgtaacggggtcccgtttacaaccctctacccgaagtacgactaccttacaaacactagtcttanactcttacaacgtntacacaactatcgagacgacgacgaacgacgaccgactacttattacgtcggacgaccgactacgtaacgtcgtaaaccgtaacgtactaacggttaacggtcggaccggggaccgacgggacccg

SEQ ID NO: 366882 - DNA, 618 bp, Homo sapiens
  misc_feature: GZ8MTXP02HUVG0.10.38.D05.1.454.CMB.2.raw
  modified_base (288)..(288): a, c, t, g, unknown or other
  modified_base (430)..(430): a, c, t, g, unknown or other
  modified_base (464)..(464): a, c, t, g, unknown or other
  modified_base (544)..(544): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcaagtaacactacngtcgaccgtcgggccccgccgacgggctaccggaaggggaacggggctggggtaggtgggtctcgtagttattaggaaacagatggacactacattattattctgtacctcggtacggaacgggtcccgttacctacccctntacccgaagcgaacctccttacccaaaacaactnttccttgtactcttacacgtatgaccacgtaatcgtaggatacgccgaacgaccgacgaccctacttattagttcggacnccggactacgaacttcggacccttaacggccttaacgttaccggtttggcccgggggacctacgggggaccccg

SEQ ID NO: 366883 - DNA, 756 bp, Homo sapiens
  misc_feature: GZ8MTXP02JST3X.10.38.D05.1.454.CMB.2.raw
  modified_base (368)..(368): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactgggaggaggctggatccaggccgtgggggtccctgagactctcctgtgcagcctcgtggttcagcatcagtaacgactacatcgaccgtcgggccccgccacggcctaccggaggggaaggggctgggaggtcgggtctcgtaagtttagtagaaacgngacgtggactacgtactaattagttactttcgtacgtaccgttccgggtaggaaccggggtcccggtttaccaaccccgttcacccgaagtacgaacccttaccttaaacccaaaacctaactactttacgttaagtacttccttacaaaccctattccgaacctaacgtaagtttcccgagggtaaacgaccggttaccggaaaccgtaaccccggacccgggttaaccccctaaaacgttttaaagttttacgtttcggggaaccgttcccgggaccgttaaaacccagggtttaccccgaaaccgtttaaccccggactttaaaccctaacggggtttttacccgggggaccgggggaaaccccggttagggggtaaaccccccg

SEQ ID NO: 366884 - DNA, 701 bp, Homo sapiens
  misc_feature: GZ8MTXP02INSMX.10.38.D05.1.454.CMB.2.raw
  modified_base (509)..(509): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggagggaggctggatccgagccgtggggggtccctgagactctcctgtgcagcctctgggtcagcatcagtaacgactacatcgacctgggccccgccaagggcctaccggaggggaacggggcgtgggaggtgggtcctcgtagttattaggaaaacagaacgtggactactaacgtattatttacttctagtacctccgtaggaaccgggggtccgtacctaccctctaccgatagacctaccttaccaaacactattcttgtatactttcaactactgtacaacgtaacttaccgnggaaacgtacggttacccgaaaccggtaaacccgtaccccgggaaccctaaccccgtttaaaactttagtttaaccgggtacgtccggtaccggaacctaactaccggtaaacccttaaaccgggtcccttacggttaaaaccggtttccgggtaacccgggggacccccgtaaagggggtaaccccccggg

SEQ ID NO: 366885 - DNA, 806 bp, Homo sapiens
  misc_feature: GZ8MTXP02H1IDI.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactgggtggagacgtggaggaggctggatccgagccgtgggggtccctgacgactctctgtgcagcctgtggtcagcatcagtaacactacagtcgaccgtcggccccgccgaggtcctaccggaaggggaacggggcgttaggggacggtttcggggttaccttacgtaaacggttttagttaacggaaaaacgtggtaacgttacgggaccctaaacttaaccgtaatttaaacttttacgtttccgtaacggtaacccgtttaccccgggttacggggtaaaaccgggggttcccccggtttaaccctacccccgttacccgtacccgaaacggtaaaccgaaacccttaacccttaaacccctaaaaactaacccttactttacctttaacgttacttctttaaaccactaacgtacgtaccaaactaacttccgaggtaacgacgttacggaaaccgaaccctacccggaaccttaacccttaaagtttacggttacggtcgtaacccgtaaccggtacctaaacgtaccggtaacgttaaaccgtcccttaaaacgtacgtttacccgggacccgggggtaacccggaacggggtaacccccgg

SEQ ID NO: 366886 - DNA, 711 bp, Homo sapiens
  misc_feature: GZ8MTXP02H9T9A.10.38.D05.1.454.CMB.2.raw
  modified_base (292)..(292): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttgactgagctgggttttccttgttgctatttcaaaaggtgtccactgtgaggttcaacgtggtggagactgggaggaggctggatccaggccgtgggggtccctgagactctcctgtgcagcctcgtgggttcagcatcagtaaccgactaacntcgaccgtccggggccccaccgacgggctacccggaagggggaacggggcgtagggaggtcggggtcttcgagttagtagaaacgagagtggacctaactaacgtatttaatttacgtttctacggtaccttaccggttaacgggtaaaccgggggtcccccggttactacccctccgtaccgaacgtacgaaacccttaacctacccaaaacctacgtaactttcccgttagttaacttccttaccaccttaagtactaccaactaaagttccgtaaggaacgagtacccgaacgtaccacccggtacctaacgtttattaacgttcgacgtaccgggcccaaagactttaacggaaacctaaccggttctaacgttaaacgttccggggtaccgggaaaccgtacggggaaccccgg

SEQ ID NO: 366887 - DNA, 738 bp, Homo sapiens
  misc_feature: GZ8MTXP02FMQ0M.10.38.D05.1.454.CMB.2.raw
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagacgtggaggaggctggatccgagccgtgggggtccctgagactctctgtgcagcctgtggttcagcatcaagtaaccgactacatcgaccgtcgggccccgccgaggcctaccggaaggggaacggggccgtagggaggtcggggttaccttacgtaaggtttaagttaggaaaaccccgtaggacgtacgggacctaacctaactaatttactttaactttcgtacgtaccgttaccgggttagggaaaccgggggtccccgtttacccaccccgttcctacccgaaggtaacaacccttaaccttaccccaaaataacctattacctttagttaaacttcctttaacaaccgtattacgaaccaactaaacgttccgtaaggacgtacggtaccgaaaccgaccgaacccggtaccctaaaccgtttagttaacgtttcggacgaccgggtaaccgaacttaacgtaacggtaaccccttacggtaccttaaccgtaaaacggtttcccggacgggggaaaccccgg

SEQ ID NO: 366888 - DNA, 598 bp, Homo sapiens
  misc_feature: GZ8MTXP02G20DS.10.38.D05.1.454.CMB.2.raw
  modified_base (358)..(358): a, c, t, g, unknown or other
  modified_base (458)..(458): a, c, t, g, unknown or other
tcagcatagtagtgcacgaccggtgctcgatttagtatctgatagttgggtttggggggagaggagcccagcactgggattccaaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtgcagcctctgggttcagcatcagtaacgactacatcgaccgtcggccccgcacggcctccgaggggaacgggcgtgggaggtgggtctcgtagttatagaaacgngacgtggacaactactattattattcgtgtacctccggtagaaccggggtcccgttaccaccccgtctcccaagacgaacctaccttacccaaactactnttccttgacttccttacactatcgacaactaagtctagacgacgtcgaaccgacaccggacctacttaattcgtgtcgaccgacgtacacgtcggtaacctccgtactactaacgttccggacggggcccgaaggacccg

SEQ ID NO: 366889 - DNA, 632 bp, Homo sapiens
  misc_feature: GZ8MTXP02FKBBN.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttcaaaaggtgtccactgtgaggttcaactggtggagactggagggaggctggatccaggccggtggggggtccctggagactcctccgtgtgcacgtcctcgtgggttcagcatcaagtaacgactacatgacctgggccccgctacggctaccgaggggaggggctgggagtgggtctctagttatagaaacagatggacactacatattattctgactccggtaggaacgggtccggttaccaccctctcacgacgacaccttccaaacaacattcttgtaacttcttacaactactcgactaactaatccgtagaacgacgtaccgaccgaaacgcccggtaccctaaccttaagtttacgttacgggttaccgcggtacccgaactaacgttccgggaaccttaacggtcccttaacgtaaacgttccgtacgggggacccaacgggggaaccccgg

SEQ ID NO: 366890 - DNA, 672 bp, Homo sapiens
  misc_feature: GZ8MTXP02JQK3S.10.38.D05.1.454.CMB.2.raw
  modified_base (275)..(275): a, c, t, g, unknown or other
  modified_base (278)..(278): a, c, t, g, unknown or other
  modified_base (307)..(307): a, c, t, g, unknown or other
  modified_base (533)..(533): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgaggccgtgggggtccctgacgactctcctgtgcacgcctcgtggtcagcntanaagacgactacagtcgaccgtccggcccncgacggccgtacggaaggggagggtcggtgggacgggttcgggtctacgtagtttaacgtaagaaacgtagtagtcgactacctaatattaacgtttacttcgtacgtcgtaccgggtacgggtaaccggggttccccgtaccctacccttccgacgaacggtaaaccctacctaacccttaacccaaaacctacgtactttcgttaataccttctaaccacgtancaacctaacagttaccgagaacgtaccgtcgaaaccgtaccggtacctaccgtaactttaggtgtccggcgtacccaacggtctacggactacgtaacgtcttaaccgtacggttcggaccgggaccgacggtcccccg

SEQ ID NO: 366891 - DNA, 674 bp, Homo sapiens
  misc_feature: GZ8MTXP02IM1WV.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttgggttttccttgttgctatttacaaaaggtgtccactgtgaggttcaacgtggtggagacgtggaggaggctggactccgagccgtgggggtccctgacgtactctcctgtcgcacgtcctcgtggttcagcatacagtaacgactacatcgaccgtcgggccccgccgaggcctacggaggggaaggggcgtgggaggtcgggtctcgtaagttatagaaactgacgtacggctaacgtaactaatttactttacttcgtacgtaccgttaccgggtacggtaaccggggttcccggttaccaaccccttcgtaccgaaacggtactaaccctaaccttaacccaaaactaccttaactttcgtttactaccttctttaaccgaactactacgtacaactagttacccgtgaaggtacgtcgaaaccgtcgaaccgtcctaacttacgtttagtcgtcgacgacgtactaacgtccgtactaacgtcctacgtaacgttcggacgggtcgaacgggtacccg

SEQ ID NO: 366892 - DNA, 609 bp, Homo sapiens
  misc_feature: GZ8MTXP02ITN31.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggtcagcatcagtaacgactacagtgacctcgggccccgccagggcctccgaggggaaggggcgtgggaggtgggtctcgtagttagttagaaacgagaacgtggacactactatatttatctgtactccgtagaacgggtccgtacaccctgtcccagacgaacctacttacccaaactaactattaccttgtacttcttacaacagtcactaacaatcctggaagacgtcgaacggtacaccggaacctacccttattagttcggtacgccgacgtaaccgtatacggacctaacggcctacggtaaactttccgggacgggggccctaagggggaccccgg

SEQ ID NO: 366893 - DNA, 566 bp, Homo sapiens
  misc_feature: GZ8MTXP02FL881.10.38.D05.1.454.CMB.2.raw
  modified_base (303)..(303): a, c, t, g, unknown or other
  modified_base (370)..(370): a, c, t, g, unknown or other
  modified_base (374)..(374): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctgggccccncaggcctccgaggggaaggggctggagtggggtctacgagttatagaaacagatggcatacatattnttcngactcgtgaacgggtccgtcaccctctccagacgaccacttacccaaacactattaccttgtaacttcttacactatcgacaactaatcgtagagacgtcgaacgacacccgggccctaaaccttacgttatgtacgccgacgtaccgatcgaactcgcttactaacgttcgtacggggcaacggggtcccg

SEQ ID NO: 366894 - DNA, 795 bp, Homo sapiens
  misc_feature: GZ8MTXP02F0KIS.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggcgtggatccgacggccggtcggggggtccctggagacctctcctgtcgcacgcctcgtggttcagcatcaagtaacgactacacgtcggacccgtcgggccccgccgacgggccgtaccggaagggggaacggggcgtggggtagtggggtctcgtaagttagtagaaacagtacgtcggacctaacgtactaattaagtttacttcgtacggtaccgttaccggtacgggaaaccggggttcccggttaccccgtaccccttacccgtaacccgacgtaaccgtaaacccttacccgtttaaacccaaaactaaacctactttacctttacgtaactttaccttaccaaactacgttacgaaccctaaacttaaacgttccgtaacggtaaacggtacgggttacccgaaacccggaacccgttaaccggggaccccttaaaaccgtttaaagttttacgttagggttccgacccggttaacgaaccgttacgttaaccggaaccctttaaccggacctttaaacgttaaccggtttccgggggacgggggtaacccgacgggggtaaacccccgg

SEQ ID NO: 366895 - DNA, 649 bp, Homo sapiens
  misc_feature: GZ8MTXP02ISV12.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaactgggtggagacgtgggagggaggcgtggatccgaggccggtgggggtcctgagctctcctgtgcacgcctcgtgggttcacgcatacacgtaacgactacatcgaccgtcgggccccgccgagggtcctacccggaaggggaacggggcgtaggggaggttcggggttctcgtaagtttaattagaaaacgagacgtcggactaactactattactttacttctacgtaccgtccggtacgggtaaccgggggtcccgttaccaccctctaccgagacgacctaacccttaccaaaactactacttcttagtactctactactatcgactacctatccgagtaaggacgtacggaaccgtacgcccgtaccacgtttattacgttggcaccgggactaaccgatccgaacctcgtcttaacgtacgttcggtacgggaccggaggtacccg

SEQ ID NO: 366896 - DNA, 576 bp, Homo sapiens
  misc_feature: GZ8MTXP02IX5QE.10.38.D05.1.454.CMB.2.raw
  modified_base (356)..(356): a, c, t, g, unknown or other
  modified_base (366)..(366): a, c, t, g, unknown or other
  modified_base (375)..(375): a, c, t, g, unknown or other
  modified_base (377)..(377): a, c, t, g, unknown or other
  modified_base (384)..(384): a, c, t, g, unknown or other
  modified_base (406)..(406): a, c, t, g, unknown or other
  modified_base (451)..(451): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagacgtggaggaggctggatccagccgtggggggtccctgagactctcctgtgcagcctctggttcagcatcaagtaacgactacatgacctcgggcccgccgaggctccgaggggaagggctgggagtgggtctctagttattaggaaacngatgcactanatattactntnactccgngaagggtcgttcacctctcccngaacacacttacaaactacaagtcttatatcttacacaagtctanactaaatctaagagaagaccgaacgaaccgacgacctaaccttaaaggttaactttacggggacgacgtacgtaacctaagtacgacgtaacgtactactacttacggtacgggacggacggacg

SEQ ID NO: 366897 - DNA, 668 bp, Homo sapiens
  misc_feature: GZ8MTXP02IPP5A.10.38.D05.1.454.CMB.2.raw
  modified_base (257)..(257): a, c, t, g, unknown or other
tcagcatagtagtgcacgaccggtgctcgatttagtatctgatagttcggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggaggaggctggatccagccgtgggggtccctgagactctcctgtgcncgcctcgtggtcagcatcagtaacgactacactcgaccgtcgggccccgccgaggcctaccggaaggggaaggggtcgtgggaggttgggtctacgtaaggtttattaggaaaacgagtacgtacggacctaactaactattaatttacttccgtagtaccgttccggtagggtaaccgggggtcccgttacctaccccgttctacccgaaagtacgaaccctacctttaacccaaaacaacttactttacgttattacttcctttacaacctatccgataactaatctagaccgtagtccgaaacgaccgaacgaccctaacttaagttcgttcgcgtaccgacgtacgtacgtcgtaacctaaccgtcttaacgtaacgttcggtaccgggggactacgggggaacccc

SEQ ID NO: 366898 - DNA, 541 bp, Homo sapiens
  misc_feature: GZ8MTXP02J1YGU.10.38.D05.1.454.CMB.2.raw
  modified_base (288)..(288): a, c, t, g, unknown or other
  modified_base (320)..(320): a, c, t, g, unknown or other
  modified_base (346)..(346): a, c, t, g, unknown or other
  modified_base (366)..(366): a, c, t, g, unknown or other
  modified_base (498)..(498): a, c, t, g, unknown or other
  modified_base (502)..(502): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctattttcaaaaggtgtccactgtgaggttcaactggtggagactggaggaggctggatccagccgtgggggtccctgagactctcctgtgcagcctcgtgggttcagcatcagtaacactacntgacctggccccgcaggctccgagggagggcnggagtgggtctcgagttatagaaacngatggcactacatattatcngactcgtgaagggtcccgttacacccgtctcccgagacgacaccttaccaactaacagttcttagtactccttacacgtatcgcaacactctagagacgtacgacgacaccggaccacttaatgtgtcgacncgancgtacacgtaacgctactacttcgcggggccaggacccg

SEQ ID NO: 366899 - DNA, 635 bp, Homo sapiens
  misc_feature: GZ8MTXP02GWOO6.10.38.D05.1.454.CMB.2.raw
  modified_base (497)..(497): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccggtgggggtccctgagactctcctgtgcagcctcgtgggtcagcatcagtaacgacacagtcgaccgtcgggccccgccgagggccgtccggaggggtaaggggcgtgggaggtcgggtctacgtagttagttagaaacgagtacgtggacactactattatttatctacgactaccggacgtaacggggtccgttaccaccccctttcaccgaacgagaccctaccttacccaaaacactattacttagtacttccttacacttanacgactactatcgaggtacgacgaccggaccgacctaccgtacctaacgttagttacgtacggcgaccgtacgtactacgtacgtaaccgtccgtacttacggttacggttccggaccggggaccggacggggtcccg

SEQ ID NO: 366900 - DNA, 630 bp, Homo sapiens
  misc_feature: GZ8MTXP02F8YDN.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccaggccgtggggggtccctgagactctcctgtgcagcctcgtgggttcagcatcagtaacgactacatcgaccgtcgggccccgccgaggcctaccggaggggaaggggctgggagttcggggtctcgtagttatagaaacagactggaccaactacattattacttcgtcgacgtccggtaggtaacggggttccgttaccacccgtctaccgtaagacgaacctacttacccaaacacctattcttacgtacttaccttacactactcgactaactaaactcctaagagtacgtaccgaacgtaaccacccggtaccctaaccttattacgttcggtacggctacggacctagacgtaacctaaccgtcctactaacgttccggacggggaccacggggacccg

SEQ ID NO: 366901 - DNA, 770 bp, Homo sapiens
  misc_feature: GZ8MTXP02JRBNP.10.38.D05.1.454.CMB.2.raw
  modified_base (307)..(307): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcagcctcgtggtcagcatcgagtaaccgactacatcgaccgtcgggaccccncgaggcctccggaaggggaggcgtggaggttcgggtctcgtagtttacgtacgaaactgaactcggactactatattacttacttcgtacgtacgttacccggtagggtaaccggggtcccggtttaccacccccggttactacccgtaacggaacgtaaccccctaaaccgtttacccccgaaaaactaaaaccctttacgtttacccgtttaacgttaccttacccgtttaacaaacgtacgttaccgaaacctaaacgtaacgttaccgtaacgggtaaacggtaccggttacccgaaaacccggtaccccgtaacccggtaacccttaaaccgttttaggtttaaccggtcggtaacccgggtaccgtaaaccggtaacctaccgttacgtaaacccgtaacctcgtttaaaaccggtaccggttcggggaaccggggacccggtaacggggacccccg

SEQ ID NO: 366902 - DNA, 588 bp, Homo sapiens
  misc_feature: GZ8MTXP02F4AZE.10.38.D05.1.454.CMB.2.raw
  modified_base (352)..(352): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtggggggtccctgagactctcctgtgcagcctctgggttcagcatcagtaacgactacatgacctggccccgccaggcctccgaggggaaggggctgggagtgggtctcgtagttatgaaacngatggacactactattattattcgtgacttccggtagaacggggtcccggttaccaccccgtcctaccgacgacgaacctaccttacccaaaacaacctattcctttagtacttccttacacattcgacaactatctagagacgtcgacacaccggacctaccgtaattgtagtcgcgtacgactatcgaacgtaacgcgtactaacgttcggtacggggaccacgggggtaaccc

SEQ ID NO: 366903 - DNA, 658 bp, Homo sapiens
  misc_feature: GZ8MTXP02FYWBV.10.38.D05.1.454.CMB.2.raw
  modified_base (174)..(174): a, c, t, g, unknown or other
  modified_base (220)..(220): a, c, t, g, unknown or other
tcagcatagtagtgcacgaccggtgctcgatttagtatctgatagttgggtttgggctgtgaggttcaactggtggagactgggaggaggctggatccagcctggggggtccctgagactctcctgtgcagcctctgggttcagcatcagtaacgactacatgacctgggcccncaggctccgagggaaggggctggagtgggtctcagttattgaaacngatggcactacattattattctgactccggtggaacgggcccgttccaccctctccagagacacttaccaaacaacatcttagattcttcacatgacacaatctgagagtacgacgacgccggacctaccctatttactgacgcgacgactagtgaacctacgcctactaaagttcggtacggggaccgaaggggaccgacccgtaacgggtccctaacccgttcccctacccccgagcccccgtacccgaaacccgaccgggacccctaacgttcccggttaccccttcccccgtcggtcccgccccgttcgccttacccggaggtaccgccgaacccgtcgacgaacgaccgaacgaccggccggcccgtacggggtcccgtcggaccggtcggtaccgaaacggtacccttacccgtaccctaccgttactaacg

SEQ ID NO: 366904 - DNA, 577 bp, Homo sapiens
  misc_feature: GZ8MTXP02JCQ3K.10.38.D05.1.454.CMB.2.raw
  modified_base (459)..(459): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgaccgtgggccccgccaggcctccgaggggaaggggctagggagtagggtctctaagttattgaaaacagatggcactacatattatctgactcgtgaacggggtccgttcacccctctcccagacgaccacttacccaaacaacctatccttagtactcttacatacgtnccaacaagttctagacgagtccgaacgccgtaacggccctaaccttaattgtttacggcgaccgcacacgtacgacctaacgcctaacgtacgttccggacggggaccgacgggaccg

SEQ ID NO: 366905 - DNA, 654 bp, Homo sapiens
  misc_feature: GZ8MTXP02JIOKJ.10.38.D05.1.454.CMB.2.raw
  modified_base (279)..(279): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtggaggaggctggactccgagccgtgggggtccctgacgtactctctgtgcacgtcctcgtggtcngcatcaagtaacgactacatcgaccgtcggcccgccgacggccgtaccggaaggggaacggggcgtagggaggtcgggtctacgtagttagtacgaaaactgagtggacctacgtataattacgttacttcgtacgtaccgtaccggtacgggtaccggggttcccggttaccctaccctccgtaccgaggaccgactacctaccaaactaactagttcttattacctcttacatacgtacacaacgtataccgaggtaacgtacggaccgacgaaccgccgtaacctaacctttgttaacgtgtaccacggtaccaacgtactaacggtactaaccgtacgttaactaacgtttccgggacgggtaaccccggg

SEQ ID NO: 366906 - DNA, 651 bp, Homo sapiens
  misc_feature: GZ8MTXP02JVERT.10.38.D05.1.454.CMB.2.raw
  modified_base (270)..(270): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggagctggatccagccgtgggggtccctgagactctcctgtgcacgcctcgtggttcngcatcaagtaacgactacatcggacctcgggccccgccacgggcctaccggaggggaacggggcgtgggaggtcgggtctctaggtttatagaaacgagacgtggactactacattattactctacgactccggagaacgggtccgtacctaccctcgtaccagaccgtaactaccttacgaaaccactacgttcttagtacttacttacactagtacgacctaataacttacccgtagaacggtaccgtacggaaccgtaaccacccgggtaactaccctttaagtttagtcgtacggcccgacgtacgtaacggttccaaccggttaacgtacccctagttaaacgttcggtaccgggggtcccaagggggtacccccg

SEQ ID NO: 366907 - DNA, 720 bp, Homo sapiens
  misc_feature: GZ8MTXP02FOYI8.10.38.D05.1.454.CMB.2.raw
  modified_base (528)..(528): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagctgggttttccttgttgctatttcaaaaggtgtccactgtgaggttcaactggtggagacgtggaggaggcgtggatccgacggccgtcgggggtccctgacgactctcctgtgcagtctcgtggtcagcatagagtaacgactacatcggaccgtcgggcccgcaggccgtacggaggggaaggggcgtagggaggtgggtctcgtaagtttatagaaacgaggacgtcggacaacgtactattattacgttcgtacgtaccggttacggtacgggtaaccggggtaccgtttcccgaacccgtttcgaccgaagtaacgaacccttacgttaacccaaacgaacttattccggtttatacttaccttacaaacgttanccgaactaacctagtttacgacggacgtaacggtacccgaacggtaccgttaaccggacccttaacgtttacgttacgtttccggtacgggaacccgtaccggtaaccgtaaacgtccggttaaaccctaacggtccttaaaccgttaacggttccggggtaaccgggggacggacggggttaaacccccgg

SEQ ID NO: 366908 - DNA, 746 bp, Homo sapiens
  misc_feature: GZ8MTXP02HWV1X.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggtagttttggctgagtcttgggttttccttgttgacttatttacaaaggtgtccactgtgtaggttcaacgtgggtggagacgtgggaggaggctggactccgacggccgggtcgggggtcccctggacgtacctcctccgtggtcgcacgtccgttcggttcggttacagctactacgtaaacgtaaccgactacgacgttccggaccggtcccggggccccgacccggaacgggtccgtacccggggaaggggtaacggggtcgttaggggtacggttcgggtcttacgttagttaagttaaacgaaagtacggagtcgacctaactataattattacttccgtcgtaccgtcggacgggtaaccggtcccgttaccacccctcgtaccagaccgtaaccctaacctacccaaaactaaactcttacttcgttactcttaccgataacgacgtaccaactattcgaaagacggacgtaccgaacgacccgtaacgtaccccttaaacgtttacgttaagttcggtacgtaccggactaaccgtataaccgtaccgtaacctacctaacggttaacgttccggggtaaccgggacgtaaccgggggaaccc

SEQ ID NO: 366909 - DNA, 597 bp, Homo sapiens
  misc_feature: GZ8MTXP02JKCT3.10.38.D05.1.454.CMB.2.raw
  modified_base (358)..(358): a, c, t, g, unknown or other
  modified_base (446)..(446): a, c, t, g, unknown or other
  modified_base (480)..(480): a, c, t, g, unknown or other
  modified_base (486)..(486): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccagccgtgggggtccctgacgactctcctgtgcagcctctgggttcagcatcagtaacgactaacatgacccgtgggccccgccagggcctaccgaggggaacggggctgggagtgggtctacgagttatagaaacngactggcactacagttattattctagtactcccggtagaaaggggcccggtttcacccgtctaccgaagacgactaccttacccaaanaacctattccgttgtaactcttacgaacattacncctaanaatcctagacgtagtccgaacacgacgtacccaacttattactgtacgcgacgaccaattcgaacttaaccgacttaccgaatttccggggcgggacccgagggtaacccg

SEQ ID NO: 366910 - DNA, 668 bp, Homo sapiens
  misc_feature: GZ8MTXP02JPMG8.10.38.D05.1.454.CMB.2.raw
  modified_base (515)..(515): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggagctggatccagccgtgggggtccctgagactctcctgtgcacgcctcgtgggtcagcatacacgtaacgactacagtcgaccgtcgggccccgccgacggcctccggaggggaagggcgtgggaggtcgggtctacgtagttagttagaaacgagacgtcgactacctaactattaacttacttcgtacgtaccgttccggtacgggtaacggggtcccggttaccacccgttcgtaccgaacgacgtaacctacctttaacccaaactacctatttccgttactacttccttacaaactntacgacctaataccttgtagaacgttacggaaccgacgtaccgtacccggaccctaaacgtttagttacttcggacggacccgacgtaacctagtccgaaaccgttcgtacccttacgtaaacgttccggggacggacccggaacgggccccg

SEQ ID NO: 366911 - DNA, 632 bp, Homo sapiens
  misc_feature: GZ8MTXP02GKHIT.10.38.D05.1.454.CMB.2.raw
  modified_base (352)..(352): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaaactggtggagacgtggaggaggctgggatccagccgtgggggtcccttagactctcctgtgcagcctcgtgggttcagcatcagtaacgactacatcgacctgggccccgcaggctccgaggggagggctgggagtgggtctacagttatgaaacnggatcggcactacattattattctgctccggtgaacgggtccgttcaccctctcgagtacgacactaccaacaacattcttagtacttcctacactactacgtacctaactaaactccgttaggaacgtacggtccggaaaccgaccgacccgggtaccctaaaccccgttaagtttacgttacgggttcgacccggtacggaactacgttaccgggtaactaccggtaaccttacgtaaactttccggcgggggtacccgacgggggtacgtcccccgg

SEQ ID NO: 366912 - DNA, 652 bp, Homo sapiens
  misc_feature: GZ8MTXP02GLIYG.10.38.D05.1.454.CMB.2.raw
  modified_base (243)..(243): a, c, t, g, unknown or other
  modified_base (375)..(375): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtctgggttttccttgttgctatttcaaaaggtgtccactgtgaggttcaactggtggagactggaggaggctggatccagccgtgggggtccctgngactctcctgtgcagcctcgtgggttcagcactcaagtaacgactacatcgaccgtacgggccccgccaggccgtaccggaaggggaacggggcgtgggaggtggggtctcgtagtttaagtagtaaaacgngactgacaactactattaacttagtttcgtactacgttccggtaggaaccggggtcccgttacctacccctccgtacctaaggacgaaccctacgttaacccaaacaacctaattcccgttatacttcctttaacaaccgtataccgtactaaacaacttcgacggtaacggacgttacggaacccgaacgacccggtactaaaccttatttacgtacgtcgacgacaacagtacgtacctaacggcctaagttactcggaacgggccgaggtaccg

SEQ ID NO: 366913 - DNA, 666 bp, Homo sapiens
  misc_feature: GZ8MTXP02GP9N2.10.38.D05.1.454.CMB.2.raw
  modified_base (290)..(290): a, c, t, g, unknown or other
  modified_base (307)..(307): a, c, t, g, unknown or other
  modified_base (497)..(497): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtggggggtccctgagactctccgtgtcgcagtcctcgtaggtcagcatcagtacgactanatcgaccgtcggccccncagcctaccgaggggaacggctggacgtgggctcgtagttattagaaacgtagacgtggacactactaattattatcgtacgtacgtaccggtagaaccggggtcccgttaccacccgttcacccgtaaggactaacctacccgttaaccaaaacgaaactcttcgttatacctcctttacaacgtttanccgtaataacctaagtcgaggacgtaacgtaccgacgtaacccgtaccgtacccttaacgtttaacgttcggttcggaccgtacggtaacccgaaccgttacgtaaccgaaaccgttcccgttaaccttaacgtacggtttccgggacggggaaccggtacggtacccg

SEQ ID NO: 366914 - DNA, 766 bp, Homo sapiens
  misc_feature: GZ8MTXP02HEEU0.10.38.D05.1.454.CMB.2.raw
  modified_base (670)..(670): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccatgtgaggttcaacgtggtggagacgtgggagggaggcgtaggactaccgacgggccgggttcgggggggtccctaggaacgtcttccgttccgtttggtcgcgacgtcccgttcgttcgggttcaacgctactacgtaaggtaaaccgtaacctaacgacttcggaacccgtccggggacccccggccgacgggacccgtaccgggaagggggaacggggtcggtacgggagggtttcggggttcctacggttaagtttaaacgttaacggaaaacgtaggtaacgttacggaacctaactaaacgtaatttaactttaactttccggtcgtaaaccgttccggggtaaggtaacccgggggttcccggtttacccaccccttacccgaccgaaagtaccgtaaccctaccgttaaccccaaaaactaccaaggtttccttagacttctactaccggatcgactacgaacttgacgtagacgtcgacncgtacgacctacttatacgttggcgcgaaacggtctacgtacgtaacctaaccgtactaacgtaccggtttcggacccggaccgggaggaccccgg

SEQ ID NO: 366915 - DNA, 708 bp, Homo sapiens
  misc_feature: GZ8MTXP02GQXWB.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtgggaggaggctggactccgacggccggtcgggggtccctgagtacctctcctgtgcacgtcctcgtgggttcagcatacgaagtaaccgactaacatcgaccgtcggccccgaccacgggcctaccggaaggggaaggggcgtgggaggtgggtctacgtagttaatagaaacgagagtcggactaactaactattaatttacttcgtacgtaccgtccggtacgggtaaccggggtcccggttacctaccccgttctaccgaggaactaaccctaccttaacccaaaactaactcttctttagtacttccttacaactacgttcgaacctaacttaacgttacgacgtaaggtaccgtaaccgaaccgaaaccggtacccgtaccctaaacgtttaagtttacgttcggaccgaccggtactaactaacgtaccgtaaccgtaacgttctaacgtaaacgttccggggacggggaacccggtacggggtaaccccg

SEQ ID NO: 366916 - DNA, 635 bp, Homo sapiens
  misc_feature: GZ8MTXP02IOBNZ.10.38.D05.1.454.CMB.2.raw
  modified_base (257)..(257): a, c, t, g, unknown or other
  modified_base (333)..(333): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtgggttttcctgttgctatttcaaaaggtgtccactgtgaggttcaactggtggagacgtggaggaggctggatccgagccgtgggggtccctgagctctcctgtgcncgtcctccgtggttcagcatacaacgtaacgaactacatcgaccgcggcccgccgacggcgccgagggaagggcgnggaggtgggtcgtagtagttattagaaacgagtagtggactacctaataattatttattcttagtacctccggtacggtaaccgggtccgggtacctaccctcctaccgacggacacaccttaaccaacaactaactcttattactacttactacattcacaactacctacttgagagtacgaacgaacgaccggtaccgtaacccttacttaagttgttcgacgtacccggtaaacgtacgtacgtaccgtaaccgtactacgttacggttacgggtaccggggtaccggaccggtaccgg

SEQ ID NO: 366917 - DNA, 706 bp, Homo sapiens
  misc_feature: GZ8MTXP02JPBMW.10.38.D05.1.454.CMB.2.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgaggccggtgggggtccctgacgtacctctcctgtgcagcctcgtggttcagcatcaagtaacgactacatcgaccgtcggccccgacgacggcctaccggaaggggaacggggctgggaggttcggggtactacgtaagttaattacggaaactaggacgtggacctacgtaactaattacttacgttcgtacgtaccggttaccggtacgggaacccggggttcccggttaccctaccccgttaccgtacccgtaacggaaccgtaacccttacccgttaacccaaaactaacctacgtttactttacggttaccttcctttaaccgacttaacgcgttaaccaactaactccgtaaggaacgtacggtaaccacggtaccaaccggtaccaacgtttaattacgttcgccgacgtcgaaactaccgtacgaactaacgtacggtactaacggttcggccgggacgaacggtaccccg

SEQ ID NO: 366918 - DNA, 735 bp, Homo sapiens
  misc_feature: GZ8MTXP02IX20P.10.38.D05.1.454.CMB.2.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccgagccgtgggggtccctgagactctcctgtgcagcctcgtgggttcagcatcaagtaacgactacatcgaccgtcgggccccgccgacggctccggaaggggaggggcgtgggagtggggtctcgtagttagttagaaacgagagtcggactactactattaagtttacttcgtacgtaccgttccgggtagggtaacccgggggttcccggtttaccctaaccccgttccgtacccgaaacggtaaccgtaaacccctaacccgtttaaaccccaaaaacctaaccttaaactttccgtttacgttaaacttaccctttacgtaaacctacgttaacgaacctaactaactttccgaacggtaaggacggtaccgaaccgaaccgaccggtaccctaactttaaacgtttgtttcggacggtaccgtaccgaactaacgttaccggtaacttaacccggacctttacgttaaacggttccggtacgggggacccggaacgggggaccccg

SEQ ID NO: 366919 - DNA, 636 bp, Homo sapiens
  misc_feature: GZ8MTXP02FMX2X.10.38.D05.1.454.CMB.2.raw
  modified_base (313)..(313): a, c, t, g, unknown or other
  modified_base (525)..(525): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtgggaggaggctggatccgagccgtgggggtccctgacgactctcctgtgcagcctcgtggtcagcatcagtaacgactacagtcgaccgtcgggcccnccgaggccgtaccggaagggggaggggtccgtggggagtcggggtctacgtagtttagtagaaacctagatggacaacgtactattattattcgtagtaccgttccggtaagggaaccggggtcccgttacccacccgtcctacgaacgacgtaacctaccttaacccaaactaactagttcttagtacttctacactagcacaacattcgngaagacgtacgaccgtacgaccgaccacgtttattacgtcggtacgaccgtacgactacgtaacgtaaccctacggtaccttaacgtaactttcggggaccggggaaccgg

SEQ ID NO: 366920 - DNA, 622 bp, Homo sapiens
  misc_feature: GZ8MTXP02JWPPK.10.38.D05.1.454.CMB.2.raw
  modified_base (400)..(400): a, c, t, g, unknown or other
  modified_base (428)..(428): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaaggtgtccactgtgaggttcaactggtggagacgtggaggaggctggactccgacggccgtcgggggtccctgacgactctctgtgcagtcctcgtggttcagcatcaagtaacgactacagtcgaccgtcgggccccgcgacgggcctaccggaggggacgggcgtgggaggtgggtctcgtagttatagaaacagacgtcgactacgtactattattattcgngtaccgtcggtagacggggtccgtaccncctcaccgagacgtaccacttaccaactactcttacgttatactccttaacactagtacgacaactaatcgtaagacggtacgaccgacgaccgaaccgacctaacttaacgttgtcgtaccggtcgaccgaactacggtacgtaccgtcgtactcgtaaacgttccggacggggacccggacggtaaccccgg

SEQ ID NO: 366921 - DNA, 602 bp, Homo sapiens
  misc_feature: GZ8MTXP02HPOFM.10.38.D05.1.454.CMB.2.raw
  modified_base (428)..(428): a, c, t, g, unknown or other
tcagcatagtagtgcacgaccggtgctcgatttagtatctgatagttgggtttgggggggaggaggagcccagcactgggattccgaggtgtttccattcggtgatcagcactgaacacagaggactcaccatggagtttggctgagctgggttttccttgttgctatttcaaaaggtgtccactgtgaggttcaactggtggagactgggaggaggctggatccagccgtgggggtccctgagactctcctgtgcagcctgtggtcagcatcagtaacgactacatcgaccgtcggccccgccagggcctaccggaggggaacggggcgtgggaggtggggtctcgtaaggttaattagaaaacagtacgtcggactactactattatttattctgtactccgtggaaccgggtccgtcaccccgtntaccgagacaacaccttaccaaacaactattcttagtactccttacacgttatacgactaacaattcgagacgtacgacgaccgacgaccggtacctactttatagtttcgacgccgtacgaactcgtagacctaacgtctaacgtacttcgggacggggaccacggggacccg

SEQ ID NO: 366922 - DNA, 684 bp, Homo sapiens
  misc_feature: GZ8MTXP02IFXTE.10.38.D05.1.454.CMB.2.raw
  modified_base (383)..(383): a, c, t, g, unknown or other
  modified_base (600)..(600): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggactccgaggccgtggggggtccctgagactctcctgtgcagcctcgtggttcagcatcaagtaacgactacactcgaccgtcgggccccgcgacgggccgtccggaagggggaacggggcgtggggaggttcggggtctacgtagtttaagttagaaaacgnggtacgtcggactaacttactaagtttaactttaacttccgtcgtaccgttacccggggtaggtaaccgggggtcccgttaccaaccccttccgtaccaaggaccgaacctaaccttacccaaaacgtaactcttttactacgttatccttaagactaagtcgaccacttatccagacgagtccgaacgaccgtaacgaccctaactttaacgtttnttcgggcgtacgacgtaactacgttacgtaacctcggtaccttaacggttacgtcgggtaccggggacggaaacgggtccccgg

SEQ ID NO: 366923 - DNA, 658 bp, Homo sapiens
  misc_feature: GZ8MTXP02JZV1G.10.38.D05.1.454.CMB.2.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtggaggagcgtggactccgaggccgtcgggggtccctgacgactctctgtgcagcctcgtggtcagcatcagtaacactacatcgaccgtcggcccgcaggctccggaggggaaggcgtggacggtgggtcctcgtaagttagtacgaaacgagactaggctaactaactattattacttcgtcgaccgtccggtaggaaccgggcccgtttccaccctctaaccgagacgtaacctaccctaccaaacactacttcttagtacttcttaccgatcgtacgactaacgtacttccgtaagacggtacgtacccggaacgaacccgacccggtaccctaaacccgtttagtttacgttcggtaccgaccggtacgtaaacgtacgtactaaaccgtcggtacccttacgtaaacggtttccggacggggtacccggaacggaccccgg

SEQ ID NO: 366924 - DNA, 690 bp, Homo sapiens
  misc_feature: GZ8MTXP02HKURF.10.38.D05.1.454.CMB.2.raw
  modified_base (279)..(279): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgagtcaactggtggagactgggaggaggctggactccgacggtccggtcggggggtccctggacgtactctcctgtgcacgcctcgtggtcngcactacagtaacacacatcgaccgtcggcccgcaggctaccggaggggaggcgtggacggtgggtctacgtagttatagaaacgtagacgtacggacacgttataattattacttcgtcgtaaccgtccggtacgggtaaccgggttcccggtacccaccccgttcgttacccgaacggtaaacgtaacctcccttaaacccgaactaaactcgttacgtttcaaacctttccttaccggaaacttctaaccgtacctaaactacgtacgacggtaacggtaccggtaaccgaaccgaaccgtaccgtacctaacgttacgtttacgtggtaccgccggtaactacctacgtaaccgtacctaaccgtcgtaaccgttacggtaccgggaccgggaccggacggtacccg

SEQ ID NO: 366925 - DNA, 736 bp, Homo sapiens
  misc_feature: GZ8MTXP02GU7NY.10.38.D05.1.454.CMB.2.raw
  modified_base (708)..(708): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagctggtattttccttgttgcttatttacaaaaggtgtccactgtgaggttcaacgtggtggagacgtgggagggaggctggactccgacggtccggttcggggggttccctggacgtacttccgttccctggtcgccgtacgtcccgttcgttcggggttcacggtacaactacgaacgtaaaccgactaacgacgtacgacccgtcgggtccccacggacggccgtaccggaagggggaacggggtcgtagggtagggttcggggttacttacgtaagtttaagtaacggaaacgtacgtaaggtcggtactaacgttactaagtttaacttacgtttcgtacggtaccgttaccgggtagggtaaaccggggttcccggttacccacccccgttacaaccgaacgggaaccgttaaccctaaccctttaaacccaaacgtaactactttcgtacttacttaccgtcaaatcgttacacctaagtaacgttcgaggagtaccgtacggacctacgcgtaaccctattcgtagttcggcgactcgatacgcgaacgtaacnctaaacgcgttccggagggaaccgtcgg

SEQ ID NO: 366926 - DNA, 621 bp, Homo sapiens
  misc_feature: GZ8MTXP02JHFEQ.10.38.D05.1.454.CMB.2.raw
  modified_base (504)..(504): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgaggccgtgggggtccctgagactctcctgtgcagcctgtgggttcagctatcaagtaaccgactacacgtcgaccgtcggggccccaccgacggtcctaccggaaggggaacggggcgtggggaggttcgggtctacgtagttattagaaacagagtggacactaacattattctctagtactccggtagacgggtcccgttaccgtaccctcctaccgtagacgtaaccaccttacccaaaactaacctattccttatacttccttacactaatccganaacccgtattccgagtagtacgcgaccacgaccggaccaacgtttatagttcgcgaccggacactacgtccgacttaacgcctacggtaacttcgggcggggtaccaaggggccccg

SEQ ID NO: 366927 - DNA, 647 bp, Homo sapiens
  misc_feature: GZ8MTXP02IUKK3.10.38.D05.1.454.CMB.2.raw
  modified_base (258)..(258): a, c, t, g, unknown or other
  modified_base (287)..(287): a, c, t, g, unknown or other
  modified_base (309)..(309): a, c, t, g, unknown or other
  modified_base (500)..(500): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactgggtggagactgggaggaggctggatccgagccgtggggggtccctgagactctcctgtgcngcctcgtggtcagcatcagtaacgactanacgtcgacccgtcgggaccccncgaggctacccggaaggggaacggggctggggacgttggggtcctagtacggtttaataggaaaacaggactcggacctacgtaacatttacttaactgtacgtaccgtccggtagtaacgggggtcccgtttacaccccgggttcaccaggtaaccgacctacttacccaaaactaccttaatccgtttnacttcctacgaactatacgacctaaccaagttacccaggacgacgtacggaaaccacggtaacccgccttaaccttaagttacgttaggtcacgaccgtacacgtcgtaaactcgaactacaacgttcgacggggacctaagggccc

SEQ ID NO: 366928 - DNA, 687 bp, Homo sapiens
  misc_feature: GZ8MTXP02GCD8G.10.38.D05.1.454.CMB.2.raw
  modified_base (401)..(401): a, c, t, g, unknown or other
  modified_base (528)..(528): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggttttcctgttgctatttcaaaggtgtccactgtgaggttcaacgtggtggagacgtgggaggaggcgtggactcccgacggtccggttcggggggtccctaggacgtaccttctccgtgtagtacgtccgttcgtcgggttcagcatcaacgtaacgactacagtcgtacccgtcgggcccccgtacgacgccgtccgggaggggtacggggcgtgggaggttgggtactcgtagtttagtagaaacngactcggacactactattattcttgtcgtaccgtacggtaggtaacccgggtccgtacctcccgtactccgataaccgactaaccttacaacactacgttcttacgtacttaccttacacgtacgtnacgtaacagtccgtagaacgtgaaccgacgtaccgaccgtaccttacttacttagttacggtcgaccgtacccggtaatacgtacccgtaagtacccgtccttaacggtaactttccgggggtacggaccccggtaaacggggccccgttaaccccggg

SEQ ID NO: 366929 - DNA, 707 bp, Homo sapiens
  misc_feature: GZ8MTXP02H9Z85.10.38.D05.1.454.CMB.2.raw
  modified_base (278)..(278): a, c, t, g, unknown or other
  modified_base (284)..(284): a, c, t, g, unknown or other
  modified_base (318)..(318): a, c, t, g, unknown or other
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcgttgggttttccttgttgcttatttacaaaaggtgtccactgtgtaggttcaacgtggtggagacgtgggaggaggcgtggactccgaggccggtgggggtccctgagactctctgtgcagccttcgnggttcngcatcaagtaacgacacagtcgacctcgggcccnccgaggcctacgaggggaagggctagggagtgggtctacgtagttagttaacgaaacaggtaacgtcggaacctactaaactattattactttcgtacgtacctccgggtaggtaaaccggggtccccggttacctaccctcccgtacaaacggtacaccctaacccttaacccaaactaacgactttcccggtaattactacccttaacaccttaacacgtaactaacgtatacgtacggaacgtacggtaacccgaccgaacccgtaccgtaccttaaccgtttagttagttcggacgtaccgaacgtaccgtacgtaccgtaaaccgtaaccgtacgttaaacccgttaggtacccggggaccggggtaaccggtaaccgggcccg

SEQ ID NO: 366930 - DNA, 606 bp, Homo sapiens
  misc_feature: GZ8MTXP02HRVTK.10.38.D05.1.454.CMB.2.raw
  modified_base (405)..(405): a, c, t, g, unknown or other
  modified_base (511)..(511): a, c, t, g, unknown or other
  modified_base (520)..(520): a, c, t, g, unknown or other
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcttgggttttccttgttgctatttcaaaaggtgtcactgtgaggttcaactggtggagactggaggaggctggatccgagccgtgggggtccctggacgtactctcctgtgcagtccctcgtgggttcagtcatacaacgtaaacgaactaacactacgacccgtgggccccgaccgacggccgtaccgaaggggaaggggcgtgggagtggggtctcgtagtttaattaggaaaacaggtaatcggactaactaanaattaatttacgttctcgtacgtacccgtaggtaaaggggtcccgtttacaccccttcaccaggacactacctaccaaacaactagtactgtaactcttacactantacaatatnagagacgacgacacaccactactacttatagtcgcgacgacactacgtacgtaacgtactactacgtacgtacggacggacggacg

SEQ ID NO: 366931 - DNA, 707 bp, Homo sapiens
  misc_feature: GZ8MTXP02HIMKK.10.38.D05.1.454.CMB.2.raw
  modified_base (477)..(477): a, c, t, g, unknown or other
  modified_base (567)..(567): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatgggtagttttggctgagtcttgggttttccttgttgcttatttacaaaaggtgtccactgtgtaggttacaacgtggtggagacgtgggagggaggcgtggactccgacggccggtcgggggtccctagacgtactctccgtgtcgcacgccttcgtcggttcagcatacaacgtaacgactacagtcgaccgtccgggccccgccgacggccgtaccggaggggaacggggcgtagggaggtcgggtctacgtagttatagaaacagactacgaactacttaactattactttatcgtacgtaccttacgggtacggtaacggggttccgtaccctccccgttanaccgaacggaactacctaaccttaaaccaaaacctactactttacgttacgtacttaccttacaaattacggacaacctaataaacgttnacgggtaaactacggtaccgaacgtaccccgacggttaaccctaactttagttacgttcggacgtaccggataacgtactacccggtacttaacgtacgtacgttacggttccgggacggggaccggaaacggtccccgg

SEQ ID NO: 366932 - DNA, 696 bp, Homo sapiens
  misc_feature: GZ8MTXP02JCHL5.10.38.D05.1.454.CMB.2.raw
  modified_base (386)..(386): a, c, t, g, unknown or other
  modified_base (401)..(401): a, c, t, g, unknown or other
tcagcatagtagtgcacgaccggtgctcgatttagtatctgatagttgggtttggggctgggagaggagcccagcactgggattccgaggtgtttccattcggtgatcagcactgaacacagaggactcaccatggagttttggctgagctgggttttccttgttgctatttacaaaggtgtccactgtgaggttcaacgtggtggagacgtggaggaggcgtggactccgacgccggtcggggggtccctggacgtacctcctctgtcgcgacgtcctgtggtcagcatcgaagtaaccgactacagtcgaccgtcggcccgcacggccgtaccggaggggagggcgtgggaggtcggtctcgtaagttagtacgaaacagtagnggacacgtactattnttactctacgtaccgtacggtacgggaacggggtcccgttaccctaacccttccgaccgaacggtacctaacccgtaccttaccccgaaaaacttacctagtttacctacgttaacctttccttaacaaccgttaggttacccgaaccttaaaacgaaaccgtttcgaaggaccggtacggttaacccggaaacccgacggttaccccggtaactaccggtttaaattcgtacggtcggaccacgttaacacgttaacgactaaccgtcaacgttaggtccgggtcggaccgggg

SEQ ID NO: 366933 - DNA, 589 bp, Homo sapiens
  misc_feature: GZ8MTXP02GM931.10.38.D05.1.454.CMB.2.raw
  modified_base (290)..(290): a, c, t, g, unknown or other
  modified_base (304)..(304): a, c, t, g, unknown or other
  modified_base (469)..(469): a, c, t, g, unknown or other
  modified_base (531)..(531): a, c, t, g, unknown or other
  modified_base (538)..(538): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtgggaggaggctggatccgagccgtcgggggtcctgagactctcctgtgcagcctcgtggtcagcatacagtaacgactanatgacctcggcccncgaggcctccggaaggggaacgggctgggacgtcgggtctacgagttatagaaactgactcgacactaacattattacttcgtcgaccgttccggtaggtaaccggggcccgttaccaccccgttcaccgaagacgacctacctaccaaaactacacttacgttntacttctaacactatcactaacatctgaacgtcgacaacgacacggaccctaactattacgngtcgacncgtacacgtcgaacaacgtctacgtaacgttcggacgggtccacggtaccg

SEQ ID NO: 366934 - DNA, 563 bp, Homo sapiens
  misc_feature: GZ8MTXP02IPYWA.10.38.D05.1.454.CMB.2.raw
  modified_base (178)..(178): a, c, t, g, unknown or other
  modified_base (264)..(264): a, c, t, g, unknown or other
  modified_base (298)..(298): a, c, t, g, unknown or other
  modified_base (304)..(304): a, c, t, g, unknown or other
  modified_base (352)..(352): a, c, t, g, unknown or other
  modified_base (361)..(361): a, c, t, g, unknown or other
  modified_base (372)..(372): a, c, t, g, unknown or other
  modified_base (379)..(379): a, c, t, g, unknown or other
  modified_base (447)..(447): a, c, t, g, unknown or other
  modified_base (455)..(455): a, c, t, g, unknown or other
  modified_base (469)..(469): a, c, t, g, unknown or other
  modified_base (477)..(477): a, c, t, g, unknown or other
  modified_base (483)..(483): a, c, t, g, unknown or other
tcagcatagtagtgcacgaccggtgctcgatttagtatctgatagttgggtttgggggggagaggagcccagcactggggattccgaggtgtttccattcggtgatcagcactgaacacagaggactcaccatggagttttggctgagctgggtttcctgttgctatttcaaaaggtntcactgtgaggtttcaacgtggtggagacgtgggaggtaggctagggatccgagccgtaggggggtccctgacgactctcctgtancagcctgtggttacagcatcaagtaacactacantaccgnggcccactagggccttccgaggggtaagggcttaggagtggggtaccngtaaggttnttggaaaaccngttacgngaccatacatattactctaggactcggagacgggctcaaccctcacaggacaacacttaccaaacaanctttctanactactacattacnctaccaanaacttnagacgacgacgacacgacgacaactacttatagtcgacgacacacacactaacactacactacgtacggacggacggacg

SEQ ID NO: 366935 - DNA, 673 bp, Homo sapiens
  misc_feature: GZ8MTXP02FNPYD.10.38.D05.1.454.CMB.2.raw
  modified_base (310)..(310): a, c, t, g, unknown or other
  modified_base (523)..(523): a, c, t, g, unknown or other
  modified_base (554)..(554): a, c, t, g, unknown or other
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactgggtggagactgggaggaggctggatccaggccgtcggggggtccctgagactctcctgtgcagcctgtggttcagcatacagtaacgactacagtcgaccgtgggccccgnacggcctaccggagggggaacggggctaggggcgtcggggtactaccgagtttaagtagaaaccgtagacgtcgacactaccgattagttatcgagtaccgtacggtggaaacggggtcccggtttaccaccccgttgttacccaaagggttacaacccgttacttaccaaacccaatacttaccgggttattactacctttaccaacgggtnttacggaccaatttaacgccgttaggaaacnccggttaccggaacgtacccgaacgggttacctaccttaaaattcgtggaactcccggaaagtacccaagttcaaaccgcctatacttaaccgggtacgggggacccaggggaaccccg

SEQ ID NO: 366936 - DNA, 608 bp, Homo sapiens
  misc_feature: GZ8MTXP02JIZFA.10.38.D05.1.454.CMB.2.raw
  modified_base (350)..(350): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggggttttccttgttgctatttcaaaaggtgtccactgtgaggttcaactggtggagacgtggaggaggctggatccagcctggggggtccctgagactctcctgtgcagctctgggttcagcatcagtaacgactacatgacctgggcccgcaggctccgaggggaaggggctgggagtggggtctctagttattgaaacngacgtgctactacattattattctgtactaccgtgaacggggtcccggtttacacccttctacccgagacgacactttaccaaaacctacattccgttataactctttaccgactacttcgaccactaaacgtctagaagacgttacggacgaccaacgggtcccaaccttaagttacttcggtacgccggatacccgtagtcgtaccgtaacgcccttataaacgtttccgacgggggtaccccaggggtaccccgg

SEQ ID NO: 366937 - DNA, 744 bp, Homo sapiens
  misc_feature: GZ8MTXP02FWKFU.10.38.D05.1.454.CMB.2.raw
  modified_base (414)..(414): a, c, t, g, unknown or other
  modified_base (613)..(613): a, c, t, g, unknown or other
  modified_base (686)..(686): a, c, t, g, unknown or other
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttacaactggtggagacgtgggaggaggctggactccgaggtccggtcggggggtccctagacgtacctctcctgtagcacgtcctcggtagggttcagctatacaaggtaaacctactacgtactccggacccgtccgggccccgaccgacggcccgtaccggaagggggaacggggtcggtagggtaggtcgggtctacgttagtttaagtagaaaacgnggtaacgtcggacctaacttaactaagtttactttacgtttccgtacgtacccggttaccgggtaacggggtaacccgggggttccccgttaccctaacccccttcgtaacccgaacggtaactaaccctaaccctaaccctaaaacaccggttacttcgttaacttactcttacaactaatccaacgtaaccaggttntaaccggagtaccgtacggaaccgtacccgaccgttcctaaactttaattcgggtctcggaccgacaacgtanaccgtaactaaccgtcttaacgtaaggttcccggacgggggacccgaaggacccccgg

SEQ ID NO: 366938 - DNA, 563 bp, Homo sapiens
  misc_feature: GZ8MTXP01EOFQS.22.11.A11.1.454.CMB.2.raw
  modified_base (253)..(253): a, c, t, g, unknown or other
  modified_base (292)..(292): a, c, t, g, unknown or other
  modified_base (423)..(423): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggtttccttgttgctatttcaaaaggtgtccagtgtgaggtgcagctggtggagactggaggagccttgatccagccgtggggggtccctgagactctcctgtgcagcctntgggttcaccgtcagagcaagtacatgagctgggtcccnccaggctccgaggggaaggggctgggagtgggatctcagttattatctccggtggtaacacgatactaacgcaagactccggtggagggccgattcaccatctcagagacaattacccaagaacacgggtntatcttacaaatggaaacagcctaggagacgccgatacgactacggccgtgtattaacgtgttgtgagtataacaaaacgttcgaaacgccggcggggttaacaacccgtaaagttcgaacgggttaacgtaaccggggg

SEQ ID NO: 366939 - DNA, 590 bp, Homo sapiens
  misc_feature: GZ8MTXP01C5N58.22.11.A11.1.454.CMB.2.raw
  modified_base (479)..(479): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagagcaagtacatgagctggtccgccaggctccgaggggaagggctggagtggatctctagtttattatcgtccggtaggtaaacactaactaactaaacgcaacggaacctcccgggtaggggaacggggcccgaatttccaacctaactcctcccaagacgaacaaacttaccaaagaactacgggtatatcttaacaaatagggaaacngaccctagacgagcccgagtacgacgacggccgtgtattaacgtgttgtgagatacaaacgttccaaagccggacggggtcaacccgaattcgaacgttcggtaaccgggg

SEQ ID NO: 366940 - DNA, 535 bp, Homo sapiens
  misc_feature: GZ8MTXP01AUQRY.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagcctgggggtccctgagactctcctgtgcagcctctgggttcaccgtcagtagcaagtacatgagctgggtccgccaggctccgaggggaggggctggagtggatctcagttatttactcgtcggtaggtaacacaaatacctaacgcagactccgtgggacgggccattcacatctccagagacaacttacaagaacacgtagtatacttacaaatagaacacgacctgagagaccgatgacacggccgtgtattactgttgtagagagttacttaaatccaaggccgcgggggtacaccgtaacgttgtaaccg

SEQ ID NO: 366941 - DNA, 570 bp, Homo sapiens
  misc_feature: GZ8MTXP01CZPVA.22.11.A11.1.454.CMB.2.raw
  modified_base (355)..(355): a, c, t, g, unknown or other
  modified_base (366)..(366): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagcgtgggtcccgccaggctccgaggggaagggggctgggagtgggatctcagttatttatctcggtggtaacnatactaacgcngactccggtgggagggccgattcaccatctccagagacaacttaccaaagaacacggtagtactctacaaatggaacagcctagagacgccgatcgacacggccgtagtattaacgtgttgtagagtaatacttaaaacttcccgaaaggcccgggacgggggtccaaccccgtaaagttcgtaaccgttaacgtaaccggggg

SEQ ID NO: 366942 - DNA, 575 bp, Homo sapiens
  misc_feature: GZ8MTXP01ETZUI.22.11.A11.1.454.CMB.2.raw
  modified_base (469)..(469): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccgccaggctccgaggggaaggggctgggagtgggatctctagttattatctccggtggtaaacacatactaacgcaagactccgtgggacgggcccgtattcaccatctaccagagaacaattacccaaagaacacgggtatatcttacaaatcggaaacaggcctgaagacgccganacgacgacggtcgtagtataagtgttgtagagtataaacaaacgttccgacggcccgggcggggtaaccaacccgtaattacggtaaccgttaacgggaaccgggg

SEQ ID NO: 366943 - DNA, 643 bp, Homo sapiens
  misc_feature: GZ8MTXP01EX33D.22.11.A11.1.454.CMB.2.raw
  modified_base (337)..(337): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatggagcgtcgggtcccgcgaggcctaccggagggggacgggcgtggaggtggatctntagtttattatcgtcggtaggtaacactatacgtaacgacaacgtaccgtcgggtagggacggggtacctacttaccacctactcctaccgaaggacaactaacttaacccgaaagtaacgtacggtattactcttaaacaaattacggggaaactacggacctaggaacgacgaccgtagacgaccgtaccgggtaccgtaggttaactaacggtggttggtaagagtaactaaacgttaaaacgttccgaacgggtcccgggacgggtaaccaaccgtaagttcgaacgttcggggaaccgggg

SEQ ID NO: 366944 - DNA, 602 bp, Homo sapiens
  misc_feature: GZ8MTXP01D33J1.22.11.A11.1.454.CMB.2.raw
  modified_base (294)..(294): a, c, t, g, unknown or other
  modified_base (365)..(365): a, c, t, g, unknown or other
  modified_base (443)..(443): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcacgcctctgggtcaccgtcagtagcaagtacatgagctgggtccnccgaggctccgaggggaaggggctgggagtggatctctagttattatctcggtggtaacacatactacgcngactcggtgggacggccgattcgaccatctccagagacaaattccaaagaacacggtatatcttacaaatgggaaacngaccctgaagcgacccgagtacgacgtaccgggccgttagtacttaacgtggttgtagaggtaataaccaaaacgtttcccgaaaaccgggtcccgggtaccggggggttaaccaaaccccgtaaattacgggtaaaccttaaccgggtaaccgggggg

SEQ ID NO: 366945 - DNA, 532 bp, Homo sapiens
  misc_feature: GZ8MTXP01APJF2.22.11.A11.1.454.CMB.2.raw
  modified_base (291)..(291): a, c, t, g, unknown or other
  modified_base (470)..(470): a, c, t, g, unknown or other
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccnccaggctccgaggggaaggggctgggagtgggatctcagtttattatctcggtggtaacacatactaacgcaagactccggtgggacgggccgattcaccatctccagagacaattaccaagaacacggtagtatacttacaaatgaacagcctagagagccgatgacacggccgtgtntaactgttgtgagatacaaattccagccggcggggtcacccgaattcgaacgttcgtcgggg

SEQ ID NO: 366946 - DNA, 638 bp, Homo sapiens
  misc_feature: GZ8MTXP01D0PN9.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgatccgagccgtgggggtccctgagactctcctgtgcagcctctgggttcaccgtcagtagcaaagtcatgagcgtgggtccgcgaggctccgaggggaggggctgggagtggatcgtcagtttatttactcgtacggtagtaacacaactactcgcaagaccgtccggtagggacggggccgtacttcacctatcctaccaagaacgaactaacttaccaaacgaaaccgtacggtagttaacttacttaacgaaaattacggaaacacgtacccgtagaacggaacggacccgaatcggaaccgaccgggtcccgttaagttaattacgtgttggtagaagttaacgttacttaaaacgttcccgaaacggtcccggtaccgggggtacccaaacccgtaaacgtttaacggtaacccgg

SEQ ID NO: 366947 - DNA, 563 bp, Homo sapiens
  misc_feature: GZ8MTXP01A1SW5.22.11.A11.1.454.CMB.2.raw
  modified_base (407)..(407): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtgggtccgccaggctccgaggggaagggggctgggagtgggatctctagtttatttatcgtccggtaggtaacactatactaacgcaagacctcccgtagggacgggccgattcaccatcnccagagacaattaccgaagaacacggtgtatacttacaaatgaacagcctagagacgccgatcgacgacggccgtgtataactgttgtgagatacgaaattccgaaggcccggcggggtaacaacccgtaaagttcgaaccgttaacggtccgggg

SEQ ID NO: 366948 - DNA, 582 bp, Homo sapiens
  misc_feature: GZ8MTXP01C24MI.22.11.A11.1.454.CMB.2.raw
  modified_base (293)..(293): a, c, t, g, unknown or other
  modified_base (356)..(356): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagcgtgggtccnccaggctccggaggggaaggggctgggagtgggatctctagttatttatctcggtaggtaacnatactaacgcaagactccgtgggacgggccgattcacatctccagacgaacaattacaaacgaactacggtagtatacttacaaatagaaacagcctagagagaccgatacgacgacggccgtgtattaactggttgtagagtaatacgaaaaacttccgaaacggtcccgggtacgggggttaaccaacccgtaaacgttacgtaacgttaacggtaaccggggg

SEQ ID NO: 366949 - DNA, 546 bp, Homo sapiens
  misc_feature: GZ8MTXP01CCORK.22.11.A11.1.454.CMB.2.raw
  modified_base (464)..(464): a, c, t, g, unknown or other
  modified_base (479)..(479): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgcaggctccgaggggaaggggctgggagtggatctcagttatttactctcggtggtaacacaaattactaacgcaagactcccgtgggacgggccgattcaccatctccagagaacaattaccaagaacacggtgtatcttacaaatgaacagcctgagagccgatgacncggccgtgtattacngttgtagagttattacaaaattccgaaacggccggtacgggggtaccaacccgtaaagttcgaaccg

SEQ ID NO: 366950 - DNA, 570 bp, Homo sapiens
  misc_feature: GZ8MTXP01AY91N.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagctgggtccgcaggctccgaggggaagggctggagtggatctcagttattatcgtcggtaggtaacacatacctaacgcaagactccggtgggacgggccgattcaccatctacagacgacaattaccaaagaacacggtatatcttacaaatggaaactagcctgagagccgatcgacacggccgtgtattaacgtgttgtagagtataacaaaacgttccgaaacggtcccgggacgggggttaaccaaccccgaaagtttcgaaccgttaacggtaaccggggg

SEQ ID NO: 366951 - DNA, 758 bp, Homo sapiens
  misc_feature: GZ8MTXP01C80QW.22.11.A11.1.454.CMB.2.raw
  modified_base (347)..(347): a, c, t, g, unknown or other
tcagacatacgcgtcacgaccggtgctcgatttagctacgactgcagggggggagaggagcccagcactgggattccgaggtgttcccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgtgggttcaccgtcagtagacaagtacatgagcgtgggtccgccgaggctccgagggggaacgggcgtgggagtgatctactagtttatttntcgttccggtacggtaacactatactaacgactaacgacgtcccggtgggaacggggccgacgttaccacctatcctaccaagacgaactaaacttaccgaaacgtaaaccgtaacggggtacttaacttaccgtttaaactaaaaacgttacggggaaaaccgtaacggtaccccgttaagggaaacggtaaccgggtacccggaacgttaacgggaaacccggtaaacccgggggtccccggtttagggtttaaacgttttaacccggttggggttacggtttaacggaaaggttaaacttaaccgttaaaaaaacgtttccccggaaaaacgggtcccccggggtaacgggggtaaccctaaaccccgtaaaaggttccggtaaacgttaaccgggtaacccgggggg

SEQ ID NO: 366952 - DNA, 710 bp, Homo sapiens
  misc_feature: GZ8MTXP01AOPCW.22.11.A11.1.454.CMB.2.raw
  modified_base (300)..(300): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgagccgtggggggtccctgacgactctcctgtgcacgcctcgtgggttcaccgtcagtagcaagtacatgagcgtgggtccncgaggctaccgaggggaggggctagggagtgggatcgtacgtagtttatttagtcgtaccggtaggtaaacacgtaactactaaccgacgtaacggtaacgtcccgggtagggacggggtccgtaacgttccgaaccctacttccgtacccgaaggtaacgaaacctaaatttaccccgaaaaggaaaccgtaccggggttattaacttacccgttaaaacgaaacgtacggggaaacgtacggtaccgtaaggaacgtacgaccgtaagtaccggaccgtaccgggttaccgttagttaacgttcgtaggttaggtaacgttaagtaaactaaacgttaaacggttccggaaccgggtccggggtaccggtaaccaacgtaagttacggtaaccggttcgggtaacggg

SEQ ID NO: 366953 - DNA, 581 bp, Homo sapiens
  misc_feature: GZ8MTXP01DMZDR.22.11.A11.1.454.CMB.2.raw
  modified_base (293)..(293): a, c, t, g, unknown or other
  modified_base (331)..(331): a, c, t, g, unknown or other
  modified_base (460)..(460): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctcgtgggttcaccgtcagtagcaagtacatgagctgggtccnccaggctccgaggggaaggggctgggagtgggatcgtntagtttattatcgtcggtaggtaaacactatactaacgcaaggactcccggtgggacgggcccgattcaccatctccagacgactaattaccgaaagaacgacgtagtaatcttacaaatgggaaaccngactagacgacgcgagacgacgtacggtcgtgtattaacgtgttgtagagtactaacaaacgttccgaacggtccgggtacgggtaaccaaccgtaagttacgtaaccgttaacggtcggg

SEQ ID NO: 366954 - DNA, 549 bp, Homo sapiens
  misc_feature: GZ8MTXP01AIMXY.22.11.A11.1.454.CMB.2.raw
  modified_base (342)..(342): a, c, t, g, unknown or other
  modified_base (483)..(483): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtggggggtccctgagactctcctgtgcagcctctgggtcaccgtcagtagcaagtacatgagcgtgggtccgccgaggctccgaggggaggggctgggagtggatctcagttatttacncgtggtgtaacacaatactaacgcagtactccggtgggacgggccgtattcaccatctccagagaacaattaccaaagaacacgtagtactctacaaatgaacagcctgagagccgatcgacacggccgtgtattacgtgngtagagacttacaaaacttccgaacggcccggtacgggggtaccaacccgtaaagttcgtaacccg

SEQ ID NO: 366955 - DNA, 566 bp, Homo sapiens
  misc_feature: GZ8MTXP01AZO1U.22.11.A11.1.454.CMB.2.raw
  modified_base (432)..(432): a, c, t, g, unknown or other
  modified_base (492)..(492): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccgagccgtgggggtccctgagactctcctgtgcagcctcgtgggttcaccgtcagtagacaagtacagtgagcgtgggtcccgccgaggcctccggaggggaacggggcgtgggaggtggatctctagtttattatcgtcggtaggtaacacatactaacgcaagcgtcggtggacggcgatcaccatcacagacgacaataccaaagacacggtntactcttacaaatcggaacagcctagagacgcgatacgacgtacgggccttagtattcgngttgtagagtaactacgaaaacgttccgaacggccgggacgggtccaaccgtattcgaacgttaacggtcgggg

SEQ ID NO: 366956 - DNA, 617 bp, Homo sapiens
  misc_feature: GZ8MTXP01EON04.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctattcaaaaggtgtccagtgtgaggtgcagctggtggagactggaggagccttgatccagccgtgggggtccctgagactctcctgtgcagcctcgtgggttccaccgtcagtagcaagtcatggagcgtcgggtccgccgaggcctaccggaggggaaggggctgggagtgggaatccgtatagtttattagtccgtcggtagtaaacagtaactacctaaacgcaagtacctcgggtgggacgggccgtattccaccatcacagacgaacaattaccaaagtaacacggtatactactacaaatgggaaacagcctagagacgaccgagtacgaacgcggtaccgtaggtacttaatgttggtagaagtaactaacttaaaacgttccgaaacgggcccgggtacgggggtaacctaaacccgtaaagttacgtaaccgttaacggtaacccggggg

SEQ ID NO: 366957 - DNA, 567 bp, Homo sapiens
  misc_feature: GZ8MTXP01DGW3B.22.11.A11.1.454.CMB.2.raw
  modified_base (286)..(286): a, c, t, g, unknown or other
  modified_base (351)..(351): a, c, t, g, unknown or other
  modified_base (512)..(512): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagcgtggtttctgttgctattcaaaggtgtccagtgtgaggtgcagctggtggagactggaggagccttgatccagccgtgggggtccctgagactctcctgtgcagcctctgggttcacgtcagtagcaagtacatgagctgggtccnccaggctcgaggggaagggctggagtgggatcgtctagtttatttatccgttcggtaggtaaacnctaacgtaactaaccggcaaggacctcccgggtgggacggggcccattcaccatctaccagagacaattaccaagaacacggtatatctacaaatgggaaacagtacctagacgagccgagtacgacgacggtccgtagtattaatgttgtagagaactanaaaacgttccaaggtccggacggggtcaacccaagttcgtaacgttaagtcgggg

SEQ ID NO: 366958 - DNA, 570 bp, Homo sapiens
  misc_feature: GZ8MTXP01AGWHW.22.11.A11.1.454.CMB.2.raw
  modified_base (441)..(441): a, c, t, g, unknown or other
  modified_base (494)..(494): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctcgtgggttcaccgtcagtagcaagtacatggagcgtgggtcccgcaggcctccgaggggagggctgggagtggatctcagtttatttatcgtcggtaggtacacatactaacgcaagactccggtgggacgggccgattccacatctaccagacgaacaattaccaaagaacacggtagtactcttanaaatggaaacacgcctagaagacgccgatcgacgtacggccgtgtattaacgngttgtagagactaacaaacgttcgaacggtccggcggggtaaccaccgtaaagttcgaaccgttcggtaaccgggg

SEQ ID NO: 366959 - DNA, 597 bp, Homo sapiens
  misc_feature: GZ8MTXP01CTZ9D.22.11.A11.1.454.CMB.2.raw
  modified_base (356)..(356): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagtttggctgagctgggttttccttgttgctatttcaaaaggtgtccagtgtgaggtgcagctggtggagactggaggagccttgatccagccgtggggggtccctgagactctcctgtgcagcctcgtgggttcaccgtcagtagcaagtacatgagctgggtccgccaggctccgaggggagggctgggagtggatctcagtttattatcgtccggtaggtaaacanatactaacgcaagctccgtggagggccattcaccatctccagacgacaaacttaccaaagaacacggtatatcttacaaatcggaaactaggcctaggagacgcccgagtcgaacgtaccgggccgtagtaacgttaacgtgttggtagaagtaactaacttaaaaacgttcccgaaaggccccgggtaccgggggttaaccaaccccgtaaagttcgaaccgttaacggtaaccgggggg

SEQ ID NO: 366960 - DNA, 673 bp, Homo sapiens
  misc_feature: GZ8MTXP01CYO11.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccaggccgtcggggggtccctgagactctcctgtgcagcctcgtgggttcaccggtcagtagacaagtacatgagcgtgggtcccgcgaggcctccggagggggaagggcgtagggagtgggatccttagtagtttatttagtcgtccggtaggtaacactactacgtaacgacaagaccgtcgagggacgggccgtacttccaaccctattccgaccaagacgtaacaaacttaaccccgaaaggaactaaccgggtataacttacttaaaccgaaaagtacggaaacgaacggtccctaaggaacggaacgtaccggaatacggaaccgtaccgggtcccgttagttacttaacgtggttgtaacgagtaactaacgttaaaacgttccggaacggtcccgggtacggggtaaccaacccgtaagttaccggtaacgttaacgggtaacccgggg

SEQ ID NO: 366961 - DNA, 656 bp, Homo sapiens
  misc_feature: GZ8MTXP01DRJ6G.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggagagccttgatccagccgtgggggtccctgagactctcctgtgcagcctcgtgggttcaccgtcagtagacaagtacatgagcgtgggtcccgccaggcctccgagggggaaggggctgggagtggatctctagtttattatcgtccggtaggtaacacgatacgtaaccgcaagtacctcccgggtagggacgggtaccgtattccaaccctatccctaccgaagacgaacaacttaacccgaaagtaaaccgacgggtattaactaccttaaactaaacgtacggaaacgacgtccgtaggaacgacgaccgtaagtacgaccgtaccgggtcgttagttacttaacgttggttaggtagaagtaataaaccgttaaaacgttccgaaccgggtcccgggtaccgggtaacccaaacccgtaagttaccggtaaccgttaacgggtcgggg

SEQ ID NO: 366962 - DNA, 590 bp, Homo sapiens
  misc_feature: GZ8MTXP01EUX4U.22.11.A11.1.454.CMB.2.raw
  modified_base (254)..(254): a, c, t, g, unknown or other
  modified_base (293)..(293): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggtttccttgttgctatttcaaaaggtgtccagtgtgaggtgcagctggtggagactggaggagccttgatccagccgtggggggtccctgagactctcctgtgcagcctntgggttcaccgtcagtagcaagtacatgagctgggtccnccaggcctccgaggggaaggggctgggagtggatctcagtttattatctcggtaggtaacacatacaacgcaagactccggtgggacgggccgtaattcaccatctacagagactaattaccaaagaacacggtgtatcttacaaatcggaaacaggcctagaacgagcccgtagtacgacgtaacgggcccgttgtaagttaacgtggttggtagaacgtataacaaaagtttcccgaaacggtccgggacgggggtccaaccccgtaaagttcgtaaccgttcggtaaccggggg

SEQ ID NO: 366963 - DNA, 589 bp, Homo sapiens
  misc_feature: GZ8MTXP01ANFP5.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtcatgagctgggtccgccaggctccgaggggaggggctgggagtggatctctagttattatctcggtggtaacacatactaacgcaagacgtccgtgggacgggtccgattcaccatctaccagagaacaacttaccaaagaactacggtgttactcttacaaatacgggaacagcctagacgagcccgatacgaccgtcggtccgtagtagttaactggttgtagagtaactacaaaacgttcccgaacggcccgggtaccgggggttaaccaaccccgtaaagttcgtaaccgttaacggtaacccggggg

SEQ ID NO: 366964 - DNA, 591 bp, Homo sapiens
  misc_feature: GZ8MTXP01CXBU9.22.11.A11.1.454.CMB.2.raw
  modified_base (329)..(329): a, c, t, g, unknown or other
  modified_base (339)..(339): a, c, t, g, unknown or other
  modified_base (377)..(377): a, c, t, g, unknown or other
  modified_base (431)..(431): a, c, t, g, unknown or other
  modified_base (514)..(514): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagtttggctgagctgggtttccttgttgctattcaaaggtgtccagtgtgaggtgcagctggtggagactggaggagccttgatccagccgtgggggtccctgagactctcctgtgcagcctcgtgggttcaccgtcagtagcaagtacatgagcgtgggtccgccgaggcctccgagggggaagggctgggagtggatctntagtttattntcgtcggtggtaaacactatactaacgcaagactccgngggacgggccattcacatctaccagagaactaactaccgaaagaactacgggtntaatccttaaacaaagtacggaaacgacgtacgtagaacgacgacgagtacgacgtaccggtcgtagtagttaagtgttgtanaagtaactaacttaaacgttccgaacggccggtacgggtaaccaaccgtaagttacgtaaccgttaacgggtaacgg

SEQ ID NO: 366965 - DNA, 788 bp, Homo sapiens
  misc_feature: GZ8MTXP01DJGHF.22.11.A11.1.454.CMB.2.raw
  modified_base (253)..(253): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtggtggagactggaggagccttgatccgagccgtgggggtccctgagactctctgtgcngcctcgtgggttcaccgtcagtagcaagtacatggagcgtcgggtccgccgaggccgtaccggaagggggaagggggtctagggggaggtgggattccgtacgtaggtttactttacgtccgttacgggtaggtaaaccactaaattaacctaacggacctaacgggaacccgttcccggggtaggggaacgggggtccccgtaactttcccaaccctacttacccgtaccgaacggtaaacgaaactaaactttaacccgaaaacgtaaaccgtaaccgggttaacgttaacgtttaccctttaaactaaaaacgttacgggaaaacctaacggtcccgttaacgggaacggaccgggaaccccggtaagttacggaacccgtaacccggggttcccggttaaggtttaacgtttaccggttaggttaggttacggtaaggttaaacttaaccgttaaaaaacgtttcccggaaaacgggtcccgggtaccgggggtaccttaaacccgtaaacggtttaaccggtaaacccgg

SEQ ID NO: 366966 - DNA, 641 bp, Homo sapiens
  misc_feature: GZ8MTXP01CU5LM.22.11.A11.1.454.CMB.2.raw
  modified_base (290)..(290): a, c, t, g, unknown or other
  modified_base (326)..(326): a, c, t, g, unknown or other
  modified_base (352)..(352): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcgtggtttcgtgtagctatttacaaaggtgtccagtgtgaggtgcagctggtggagactggagagccttgatccagccgtgggggtccctgagctctcctgtgcagcctcgtgggttcacggtcagtagcaagtcatgagcgtgggtccncaggctaccgaggggaagggctgggagtggatctanagttattagtcgtacggtaggtaacnctatacgtaacgcaagtacgtacccgggtgggacgggtcccaatttccaaaccctacttctaccccgaaggtaacgaaacctaacttaccccgaaagaaacctaccggggttattaacttaccgtttaaccaaagttacggggaaactacggtacctagggaacgaacgcccgataccggacgtaaccggtccgttagtacttaacgtggttgtaggaaacgtataacgaaaacttccgaaggcccggacgggtccaacccgtaagttcgtaaccgttaacggtcgggg

SEQ ID NO: 366967 - DNA, 575 bp, Homo sapiens
  misc_feature: GZ8MTXP01BP6LF.22.11.A11.1.454.CMB.2.raw
  modified_base (362)..(362): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggtcaccgtcagtagcaagtacatgagctgggtccgccaggctccgaggggaaggggctggagtggatctcagttattatctcggtggtaacacatactaacgcngactccggtgggacgggccgtattcaccatctacagagacaaattacccaaagaacacggtagtactcttacaaattacggaaacacgcctaggagacgaccgagtacgactacgggccgtgtattaacgtgttgtagagatacaaaacgttccgaacggccgggacgggggtaaccaacccgaagttacgtaaccgttaacggtaaccgggg

SEQ ID NO: 366968 - DNA, 740 bp, Homo sapiens
  misc_feature: GZ8MTXP01DS8Z7.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgcttatttacaaaaggtgtccagtgtgaggtgcgagcgtggtggagacgtggaggagccttgatccgagccgtgggggtccctgagctctcctgtgcagcctcgtcggtcaccgtcagtagacaagtacatgacgcgtcggtcccgacgacggccgtaccggagggggaagggcgtagggtagtggtactcgtacgtaagtttaatttacgtcgttacggtacggtaaacacgtaacttaaccgtaaaccgacgaacggtaccgtcccgggtaggggaccgggtacccgtaacttacccaaccctactaccgtaccccgaaaggaactaaacctaaacgttaccccgaaaaggtaaaccgtaacgggttaacgttaacttaacgttaaactaaaacgttacggggaaaactacggtacctaagggaacgaaccggacccgtagtaaacggccgtaaccgggtccgttagttaatttaacgtggttagtagaagtaaacttaaacgttaaaacgttccggaaaccggtccgggaccgggtaaccaaccggtaattacggtaaccgttaacggtaaccccggggg

SEQ ID NO: 366969 - DNA, 571 bp, Homo sapiens
  misc_feature: GZ8MTXP01E0AHR.22.11.A11.1.454.CMB.2.raw
  modified_base (442)..(442): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggagagccttgatccagccgtggggggtccctgagactctcctgtgcagcctcgtgggttcacgtcagtagcaagtacatgagcgtggtccgccaggctccgagggagggcgtggagtggatctcgagttatttactcgtcggtaggtaacacgaatactcgtcagacctccggtagggacggggcctacttccacctagtcctcagagacaattccaagaacacggtagtatccttanaaatgaaacacgtcctagagacgacccgatacgacaccggccgtaagtattacgtgttgtgaagacttacttaaaacgttccgaaaggcccgggtcgggggttaccaacccgtaagtttcggaacccgg

SEQ ID NO: 366970 - DNA, 603 bp, Homo sapiens
  misc_feature: GZ8MTXP01D3AYN.22.11.A11.1.454.CMB.2.raw
  modified_base (295)..(295): a, c, t, g, unknown or other
  modified_base (330)..(330): a, c, t, g, unknown or other
  modified_base (368)..(368): a, c, t, g, unknown or other
  modified_base (399)..(399): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctattcaaaaggtgtccagtgtgaggtgcagctggtggagacgtggaggagccttgatccagccgtgggggtccctgagactctcctgtgcacgcctcgtggttcacgtcagtagcaagtacatgagcgtagggtccncgaggctccgaggggaagggctggagtggatcgtnagttattatcgtcggtggtaaacactatactaaacgcngactcccggtggacgggccaagttcaacctntctacagactaactaactacaaagacgtaggtatactactaacaaagtcgaacacgacgagacgacgacgacgtacgacgtacggtacgtacgttagttaacgtgttaggtagttaagtaaacgtaacttaaacgttaacgttaaccggtaaccggtaccgggtaaccgtaaccgtaacgttacgtaacgttaacggtaacggg

SEQ ID NO: 366971 - DNA, 602 bp, Homo sapiens
  misc_feature: GZ8MTXP01EYM56.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagagcaagtacatgagcgtgggtccgccgagggctccggagggggaagggggctgggagtgggatctctagtttatttatcgtcggtaggtaaacacgatacctaacgcaagacgtccggtgggacgggccgattcacctatctccaagacgacaacttaccaaagtaacacgggtatactcttaacaaatggaacagacctaggaagacgaccgagtacgacgtacgggccgttaggtattcgtgttggtagagtataacttaaaacgttccgaaacggtcccggacgggggtaaccaacccgtaagttcgtaaccgttaacggaaccggggg

SEQ ID NO: 366972 - DNA, 539 bp, Homo sapiens
  misc_feature: GZ8MTXP01B3HTE.22.11.A11.1.454.CMB.2.raw
  modified_base (253)..(253): a, c, t, g, unknown or other
  modified_base (290)..(290): a, c, t, g, unknown or other
  modified_base (346)..(346): a, c, t, g, unknown or other
  modified_base (358)..(358): a, c, t, g, unknown or other
  modified_base (385)..(385): a, c, t, g, unknown or other
  modified_base (390)..(390): a, c, t, g, unknown or other
  modified_base (413)..(413): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctntgggttcacgtcagtagcaagtcatgagctgggtccncaggctccgagggaaggggctggagtgggatctcagttattatctcggtggtaacncatactaacgcngactccgtggagggccgattcacatcnccagngacaattaccaagaacacgggtntatcttacaaatgggaacagcctagagaagccgatcgacacggccgtgtataactggttgtggagatacaaaagttcccgaaagcccggcggggtaacaacccgaaattgaacttaacggtcgggg

SEQ ID NO: 366973 - DNA, 648 bp, Homo sapiens
  misc_feature: GZ8MTXP01CK48K.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagctgggtccgcaggctccgaggggagggctgggagtggatcgtcgtagtttatttaccccgtctcggtggtaaacacgtaaattaacctaacgcaagaccgttccgggtgggacggggcccgaattccaacccgatcctaccgaagacgaacctaaacgttacccaaagaaaccgtacgggttagtaacttacctttaacgaaagttacggaaactaacggccctaggacgacgcccgaagtcgaaccgaccgggtcccggtaagttaagttacgtggttggtagtaagttacttaccttaaaacgttcccgaacggtcccgggtacgggggttaccaaacccgtaacgttcggtaacccgg

SEQ ID NO: 366974 - DNA, 575 bp, Homo sapiens
  misc_feature: GZ8MTXP01CEPXZ.22.11.A11.1.454.CMB.2.raw
  modified_base (292)..(292): a, c, t, g, unknown or other
  modified_base (340)..(340): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagctctcctgtgcagcctctgggtcaccgtcagtagcaagtacatgagcgtgggtccnccaggctccgagggggaagggctgggagtggatctctagtttatttancgttcggtaggtaacactatactaacgcaagactcccgggtgggacggccgattcaccctatctaccagacgaacaattaccaaagaacacggtagtactacttacaaagtgggaaacagcctagacgagccgatcgacctacggccgtagtacttaactggttgtagagtatacaaaacgttcgaacgccggacggggtaacaacccgtaaagttcgaacgttcggaaccgggg

SEQ ID NO: 366975 - DNA, 692 bp, Homo sapiens
  misc_feature: GZ8MTXP01AQQ1B.22.11.A11.1.454.CMB.2.raw
tcagacatacgcgtcacgaccggtgctcgatttagctacgactgcagggggggagaggagcccagcactgggattccgaggtgttcccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgacgactctcctgtgcagtcctcgtgggttcaccgtcagtagcaagtacatgagcgtgggtcccgccgaggccgtaccggagggggaagggggctggggagtgggacttcgtacgtagtttatttacgtcgttccgggtaggtaaacacgtattacaaaccgcaaggtaccgtccgggtagggacgggaccgtacttccgaaccctatccgtaccaagaacgaactaaacgttaccgaaacgaaccgtaacggtagttaactacttaacaaagttacggaaacgacgaccgtaggaacgacgtaccgaagtacgaccggtacggtacccgttagttattaacgtaggttaggtagttaagtaaacgtaacgttaaaacgttcccgttaaacggcccgggtaccgggggtaaccctaaacccgtaaacgttacggtaaccgttaacgggtaacccggggg

SEQ ID NO: 366976 - DNA, 664 bp, Homo sapiens
  misc_feature: GZ8MTXP01DDG60.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtgggaggagccttgactccgagccgtggggggtccctgacgactctccgtgtgcacgccctcgtcgggttccaccgtcagtagacaagtacatgagcgtcgggtcccgcgagggctaccggagggggaagggcgtgggagtggtactcgttactagtttatttagtccgtacggtacggtaaacactaactactaaccgcaacgtccgtccgggtagggacgggtcctattccaccgacttctacccgagaacgaactaaacgttaccgaaacgtaacgtaccgggtattaactaccgttaactaaacgtaggaaaccgtacgtacccgtaggacgaaccgccgtaagtacgacgccggttaccgtagttattaacgtgttagtagaagtactaacttaaacgttcgaaacggtccggacgggtccaacccgtaagttacgtaacgttaacggtaaccgggg

SEQ ID NO: 366977 - DNA, 605 bp, Homo sapiens
  misc_feature: GZ8MTXP01C62K5.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggtcaccgtcagtagcaagtacatgagcgtgggtcccgccgaggcctaccgagggggaaggggctgggagtggatctcagtttatttactcgtacgggtggtaaacacaaattacctaacgcagtaccgtccggtagggacgggccgattccaccatctccagtaacgaactaacttaccaaagaacgacgtagtactacttacaaacttacgaaactacgacccgtagacgacgaccgatacgacgaccggcgtaagtattacgtgttgtagagttacttacttaaaacgttcccgaaacggtcccgggtacgggggtaccaacccgtaaagttcggtaacccgg

SEQ ID NO: 366978 - DNA, 692 bp, Homo sapiens
  misc_feature: GZ8MTXP01DXUDZ.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtgggtggagacgtggaggagccttgatccgagccgtgggggtcctgagactctcctgtgcacgtcctcgtgggtcacgtcagtagcaagtacatgagcgtcgggtccgccgaggcctaccggagggggaacggggcgtgggagtgggaatcgtacgtaagtttattacgtcgtccgggtaggtaaacacgtataaccgtaacgcaagaccgtccgggtagggacggggccctagtccaacccattaccacagacgaactaacttaccgaaagaacgtacgggtattaactcttaacaaaagttcggaaactacggtacctaggaacgagacccggtaagtacggaaccgtaaccgggtccggttagttaaagttaacgttggttaggtaacgttaggtaaacgtaacttaaaaacgttcccggaaacgggtcccgggtaccgggggttaacccaaaaccccgtaaagttaccggtaacgttaaccggggtaacccggggg

SEQ ID NO: 366979 - DNA, 629 bp, Homo sapiens
  misc_feature: GZ8MTXP01CD97Q.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctcgtgggttcaccgtcagtagcaagtacatgagcgtcgggtccgcaggctccgaggggagggcgtgggagtggatctactagtttatttacgtcgtacggtaggtaaacactaaattaaccgtaacgcgaaggtacccgttccgggtaggggacggggtcccgtattacccaaccgtactcctacccgaagaacgaactaaacttaccaaacggaacgtacggttagtataccttaacaaaattacgaaaccaacgaccctagaacgacgacgacgtagaccgacggtccgtaagttacttacgtgttgtagtagattaacgaacttaaccgacggtccggacgggggtaccaacccgtaagttcgtaacccgg

SEQ ID NO: 366980 - DNA, 607 bp, Homo sapiens
  misc_feature: GZ8MTXP01AVYNU.22.11.A11.1.454.CMB.2.raw
  modified_base (291)..(291): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagtttggctgagctgggtttcctgttgctattcaaaggtgtccagtgtgaggtgcagctggtggagacgtggaggacgccttgacgtccggcgtgggggtccctgagactctcgtgtgcacgctcgtggttcacgtcagtagcaagtacatgagcgtgggtccnccaggctaccgagggggacgggctaggagtggatcgtactagtttattatcgtcggtcggtaacagactacgtacgcagtctccgggtgggacgggcctattccaacctatcctacgacgacgaacaacttacaacgaacgacggtagtacttactaacaatacgaactcgacgtagagacgacccgagacgacgacggtccgtagttactacgtgtgttagtaacgacgttaaacaaaacttaccgaacggttacccggtaacgggggtacctaaccgtaacgttacggaccgttaacggaacgggtaacccggg

SEQ ID NO: 366981 - DNA, 690 bp, Homo sapiens
  misc_feature: GZ8MTXP01ED39E.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtcctgagactctcctgtgcacgcctcgtgggttcaccgtcagtagacaagtacatgagcgtggtccgcaggctaccgaggggaaggggctgggagtgggatcgtacgtagtttatttaagtcgttaccggtaggtaaacactaataccgtaacgacaaggtacctcccgggtagggacggggtccgtatttccaacctactctaccgaagaacgaactaaattacccgaaagtaacaaccgggttataacttacttaacaaattaggggaaacacgtacccgtaggaacgaacgacccgaagttaacggaaccgtaccgggtacccgttaggttaacttaacgttggttaggtagttaaaggtaacgttaaacttaaaaacgtttcccgaaacgggtcccgggtaccgggggtaaccaaaccccgtaaagttaccgtaaccgttaacgggtaaccccggggg

SEQ ID NO: 366982 - DNA, 766 bp, Homo sapiens
  misc_feature: GZ8MTXP01CV85J.22.11.A11.1.454.CMB.2.raw
  modified_base (257)..(257): a, c, t, g, unknown or other
  modified_base (282)..(282): a, c, t, g, unknown or other
tcagacatacgcgtcacgaccggtgctcgatttagctacgactgcaggggggggagaggagcccagcactgggattccgaggtgtttccattcggtgatcagcactgaacacagaggactcaccatggagttttggctgagcgtggtttctgtagctattacaaaggtgtcagtgtgaggtgcagcgtggtggagacgtggaggagtccttgactccgaggtccggtcgggggtccctgacgtctctccgtgtcgcncgtccgtcgtcgggttccaccgtanagtacgacaagtacagtggacgtccggtcgggcccgaccgagggtccgtaccgggaagggggaaggggtcgtagggagtagggtactcgtagttagtttaattcgtcgtacggtacgtaaacactatacaacgactcggtacgtccgggtagggaccgggtcctacttaccaacccttactacccgaacgaacgtaactaaaccttaaaccgtaacgaaacggtacgtacggttattaaaccttactaaacaaacgtaacggtaaacgtaacgtacgtaacggaacgaccgaccgtacgtaaccggtaaccggtaccggtaccgttacgttaacgttaacgttacggttacggtaacgttaaacgtaaacgttaaacgttaaacccggttaacccggttaacccgggtaacccgggtaacccgggtaacccggtaaacccgttaaaccggttaaccggtaaccgggttaaccgggtaaccgggg

SEQ ID NO: 366983 - DNA, 759 bp, Homo sapiens
  misc_feature: GZ8MTXP01D35UD.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagtttggctgagctgggttttccttgttgctatttcaaaaggtgtccagtgtgaggtgcagctgggtggagacgtgggaggagccttgatccgaggccgtggggggtccctgagactctcctgtgcagtcctcgtcgggtcaccgtcagtagacaagtacagtgagcgtgggccgcgaggcctccggaagggggagggcgtgggagtggatctcgtagtttattagtcgtaccgggtagtaacactaactacgtaaccgacgtcggaccgtccgggtacgggacggggtaccctacgttccaaccctattcccacccgaaaggaacgtaaacctaaaacgtttaaccccgaaaaaggtaaaccgttaccgggttagttaaacttaccctttaaacgaaaacgtttacggggaaaacgtaaccggtcccgttaaggaaaccggaccggaacccggtaagtacccgggtaaacccggtaccgggtacccgtttaggttaaacgttaacgttgggttaggtaaggaaacgtaaacttaaaccgttaaaaaccgtttcccggaaaaccgggtccgggtaaccggggtaacctaaaaccccgtaaggttacgtaaccggttaacggtaacccggggg

SEQ ID NO: 366984 - DNA, 776 bp, Homo sapiens
  misc_feature: GZ8MTXP01CYTN3.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagctggtggagacgtgggaggagccttgactccgagccggtggggggtccctgagactctccgtgtgcacgcctcgtcgggttccaccgtcagtagacaagtacagtgagcgtcgggtcccgccgaggccgtccggaagggggaacgggggtcgtaggggagtgggtatcttacgtagtttattagtcgttaccggtaggtaaacactaactacgtaaaccgacaacggtaccgtccgggtacgggacgggcccgtacttaccaccctactcctacccgaagacgtaacctaaacgttaccgaaaacggtaaacctaacggggttacgttaacttaccttaaacgaaaacgttacgggaaaaccgtacggtacccgtagggaaacggtaaccggaccccggttaagttaaccgggaacccggtaacccggggtacccgtttaggttaaacgtttaaaccgtttggttacgggttaggaaacgttaaactaaacgttaaaaaaccgttcccggaaaacgggtccccggggtaccggggtaaccctaaacccgtaaagttacggtaaccgttaacgggtaacccggggg

SEQ ID NO: 366985 - DNA, 651 bp, Homo sapiens
  misc_feature: GZ8MTXP01DM82T.22.11.A11.1.454.CMB.2.raw
  modified_base (475)..(475): a, c, t, g, unknown or other
  modified_base (486)..(486): a, c, t, g, unknown or other
  modified_base (500)..(500): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgactccgagccgtgggggtccctgagactctcctgtgcagcctcgtgggttcaccgtcagtagcaagtacatggagtcgtcgggtccgaccgaggcctccggaagggggaagggctgggagtgatcgtctagtttattatcgtcggtaggtaaacacaattaccgaaccgacgaagtacccgtccgggtagggaccgggcccgtaattaccgacctactcctaccgaagacgaacctaaacgtaccgaaagaactacgggtntaactcttaanaaacttcggaaacngacctagagaacgccgaagtccgaaccgtcgggtaccgttgttaacttaactggttggtaggaactaaacgtaacaaaaacgttccgaaacgggtcccgggtacgggtaaccaaccctaaaagttcgtaaccgttaacggtaacccggggg

SEQ ID NO: 366986 - DNA, 629 bp, Homo sapiens
  misc_feature: GZ8MTXP01EIL59.22.11.A11.1.454.CMB.2.raw
  modified_base (257)..(257): a, c, t, g, unknown or other
  modified_base (274)..(274): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtggtggagacgtggaggagccttgactccgagccgtgggggtccctgagtactctcctgtgcngcctcgtggtcaccgtnagtagacaagtacatgagcgtcgggtccgccgacggctaccggagggggacgggtcgtagggagtggattcgtacgtagtttatttacgtcgtaggtagtaacactaactacgtcgacacgaccgtccggtagggacgggctactaccactactctacagacgtaactaactaccgtaacgaacgtacgtacgtactacttaacgtaaactaacgaacgtacgactacgggggggggacacggacgtacgtacgacgaccggtccgtaagtacgttacgtgttgtagtagttaacgttaacttaaacgtaaccgacggccggtacgggtaccgaaccgtaacgttaacgtaaccg

SEQ ID NO: 366987 - DNA, 799 bp, Homo sapiens
  misc_feature: GZ8MTXP01DTMN6.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagactggaggagccttgatccgagccgtgggggtccctgagactctcctgtgcagtcctcgtgggtcaccgtcagtagacaagtacagtgagtcgtcgggtcccgccgaggccgtaccggaagggggaacgggggtcgtaggggacggtgggtacttccgtacgttagttttaacttttaccgtccggttacgggttaacggtaaaccaacgtaaaaccgttaaccgttaaccggacgtaaacgggtacccgttccggggtacggggtaccgggtaccggtaactttcccgaaaccctacttacccgtaccgaaagtaaaccggtaaacctaaaccgtttaacccgaaaaggtaaccccgtaagggttacttaaacttacccttaaaggaaaacgttacggaaacctacgtacccgtaaggaacggaccggaaccgtaagtccggtaaccgtaccgggtaccgtttaagttaaacgtttcggtacggttaggtaaaggtaagttaaaccttaaaccgttaaaaaccgttcccgggaaaacgggtccccgggggtaacggggtaacccttaaacccggttaaagtttccggtaaacccggg

SEQ ID NO: 366988 - DNA, 650 bp, Homo sapiens
  misc_feature: GZ8MTXP01A0ACC.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctctgtgcagcctcgtggttcaccgtcagtagacaagtacatggagcgtcgggtcccgccgacgggcctccggagggggaaggggcgtgggaggtggatcgtactagtttatttatcgtccggtaggtaacatactactaacgcaagtaccgtccggtagggacgggccgtattccgactactcctaccagacgaactaacttaccaaagaacgtacggtattactacgttaacaaagtcggaaacgtacgtacctaggaacgacgaccgaacgtacggaccgtaccgggtccgttagttaacttaacgtgttggtagaacgtaaactaacgttaaaacgttccgaaacgggcccgggtacggggtaacccaaccgtaagttacggaaccgttaacgggtaacccggggg

SEQ ID NO: 366989 - DNA, 607 bp, Homo sapiens
  misc_feature: GZ8MTXP01A6VLQ.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtggtggagactggaggagccttgatccgagccgtgggggtccctgagactctcctgtcgcagtcctcgtgggttcaccgtcagtagacaagtacatgacgcgtcgggtcccgccgaggcctaccggaagggggaacgggggcgtagggagtgggattctacgtagtttatttacgtcgttggtagtacacaatacgtcgcacgacgtccgtggacgggcgtactaccacgtatcctcagacgtacaacttacaacgaacgtacgtagtaacttacgttaacaaagtacgtaaaccacgtaccgtagaaggacgacccgatacgaccgtacggtccgtaagtacttacgtgttgtagattagttacttaaacgttaacgacggccggacggggtacaccgtaagttcgtaacgg

SEQ ID NO: 366990 - DNA, 860 bp, Homo sapiens
  misc_feature: GZ8MTXP01BOZIR.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggtagttttggctgagtcgttgggtttttccttgttgcttatttacaaaaggtgtccagtgtgaggtgcagctggtggagacgtggaggacgccttgatccgaggccggtcgggggtccctgagtactctccgtgtgcagtcctcgtcgggttcaccgtcagtacgacaagtacagtgacgtcgtacgggtcccgccgagggccgtaccggaagggggaacgggggtcgtaggggaggttggacttccgttacgttaagttttatttaccgtacggttacgggttaacggtaaaccacgtaaacgttaaccgtccgacgtacgggtaacccgttcccggggtaggggtaacgggcccgttaattacccaacccgtacttcccgtaacccgaaggtaaacgtaaacccgttaaacgtttaaaccccgaaaagggtaaaccccgtaacgggggtttaacttaaacgtttacccgtttaaacgaaaaacgtttacggaaaacccgtacggtaccccggttaaggaaacggaaccggtaccggtaaacgttaccgggaacccgtaaccggggttccccggtttaaggttttaaccttaaccgggttggttaacgggttaagtaaacggttaaaactttaaaccgttaaaaaccgtttcccgggaaacgggttccccgggggtaaccgggggtaaaccccttaaacccggttaaaacgttttccggaaaaccccgggg

SEQ ID NO: 366991 - DNA, 649 bp, Homo sapiens
  misc_feature: GZ8MTXP01CAISF.22.11.A11.1.454.CMB.2.raw
  modified_base (306)..(306): a, c, t, g, unknown or other
  modified_base (361)..(361): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtggtggagacgtggaggagccttgatccgagccgtcggggggtccctgacgactctcctgtgcagcctgtcgggtcaccgtcagtagacaagtacagtgacgcgtcgggtcccnccgaggcctaccggagggggaacgggcgtgggagtgggatcgtctagtttatttntcgtcggtaggtaacactatactaacgcaagacgtccggtgggacgggcctacttcaccgactctaccgaagacgaactaacttaaccgaaacgtaacgtacggtagtactacttaacgaaacgtacggaaacacgtccgagtaacgacgaccgagtacggaaccgtacgggtccgtacgttaattaacgtgttaggtagttagtaactaacttaaacgttaccgaacggtaaccggtaccgggggtaaccaacccgtaagttaccgtaacgttaacggtaaccgggg

SEQ ID NO: 366992 - DNA, 799 bp, Homo sapiens
  misc_feature: GZ8MTXP01BRGG8.22.11.A11.1.454.CMB.2.raw
  modified_base (257)..(257): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagactggaggagccttgatccagccgtgggggtccctgagactctcctgtgcagcctntgggtccaccgtcagtagcaagtacatgagcgtagggtccccgccgtaaggcctcccggaaagggggaacgggggccgtaggggaaggttgggaacttcctacgtaaggttttaactttaacgtccgttacgggtaggttaaaccacgtaaacttaaccgttaacgctaaacggtaccttcccgggtaggggtaacgggggcccctaactttacccaaccctacttccgtaccccaaggaaacggaaaccgtaaaactttacccgaaaaggtaaaccgtaaccggggttaacggttaaacgttaccctttaacggaaaaacgtttacgtaaaaccgaacgtaacccgttaccggaaaggaaccgaaccccggtaagttaccggaaaccggtaacccggggtcccggttaaccggtttaaagtttaaaccgttacggtttcggtaacgtaaggttaacttaaccgttaaaaacgtttaacccgaaacgggtaacccgggtaccggggggttaccaaaccccggtaaaagtttcgtaaacccgg

SEQ ID NO: 366993 - DNA, 637 bp, Homo sapiens
  misc_feature: GZ8MTXP01CLG93.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagtcttgggttttccttgttgcttatttcaaaaggtgtccagtgtgaggtgcagcgtggtggagacgtggaggagccttgatccgagccgtgggggtccctgagactctcctgtgcagtcctcgtggtcaccgtcagtagcaagtacatggagtcgtcgggtcccgccgaggccgtaccggaagggggaacgggggcgtagggaggtggattctacgtagtttatttactcgtcggtagtaacactaactactcgacacgtacgtcgggtggacggggtctacttccacctatcctacgaagaacgaactaacgttaccgaaagtaaccgtacggtattactacgtttaacaaattacgaaacacgtccgtagaacggacgacccgtagtacgacgtccggtaccgttaagttactttacgtgttgttacgagttaagttacttaaacgttccgaacggtcccgggtcggggtaccaaccgtaagttcggtaaccgg

SEQ ID NO: 366994 - DNA, 646 bp, Homo sapiens
  misc_feature: GZ8MTXP01D9E0X.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtgggtcccgcgaggctccgaggggaaggggctggagtggatcgtactagttattatcgtccggtaggtaacacatactaacgcaagactccggtgggacggccgattcaccatctcagagaacaacttaccaaagaacacggtagtacttacttaacaaaattacgggaaacgacgtacccgtaggaacgaacgccgaacgtacgaaccgtaccgggtacccgttagttaacgttaacgttggttaggtacggttaagtaaacttaacgttaaaaacgtttcccggaaacggtcccggggtaccgggggttaacccaacccgtaaaagttaccggtaaccgttaacgggtaacccggggg

SEQ ID NO: 366995 - DNA, 594 bp, Homo sapiens
  misc_feature: GZ8MTXP01BOZT6.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagctctcctgtgcagcctcgtgggttccaccgtcagtagcaagtacatgagcgtggtccgcaggctcgaggggagggctggagtggatctctagtttattatcgtcggtagtaacactatactaacgcaacgactccggtgggacggccagttccacatctaccagacgaacaattacccgaaagtaacacgggtatactacttaacaaagtaggaaactacgcctaggaacgacgccgaagtacgacgtaccggtcgtagttagtaacgttgttaggtagagtaactaacaaaacgttccgaaacggcccgggacggggtaaccaaacccgtaaagttcgaacgttaacggaaccgggg

SEQ ID NO: 366996 - DNA, 693 bp, Homo sapiens
  misc_feature: GZ8MTXP01AD3S8.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagcgtggtggagacgtggaggagccttgatccagccgtgggggtccctgagactctccgtgtgcagtcctcgtcgggtcaccgtcagtagacaagtacatgagcgtcgggtccgccgaggcctccggaagggggaacggggctagggacgtgggatcgtctagtttattagtcgtcggtaggtacactatactaacgcaacgccgtcggtagggacgggcctagttccacgtactctaccaagtacgaactaacttaccgaaagtaaccgtaccgggttagttaacttacctttaacaaaacgttacggaaaccgacggtaccctaagggaacgacggacccggtaaagttaccggaacccgtacgggtacccgttagttaacgttaacgtgggttagtaggaacgtaactaaccgttaaaacgtttcccgaaacgggtccccggggtaccggggtaacctaaaccccggtaaagttaccggtaaccgttaaccgggtcccggggg

SEQ ID NO: 366997 - DNA, 661 bp, Homo sapiens
  misc_feature: GZ8MTXP01AYCSQ.22.11.A11.1.454.CMB.2.raw
  modified_base (378)..(378): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctgtgggtcacgtcagtagcaagtacatgagcgtcgggtccgccgaggcctccggagggggaacgggggctgggagtgggaatcgtacgtagttattagtcgtcggtagtaacacatactaacgcngactcggtagggcggccagttcacctatctaccgagacgaacaacttaccgaaacgtaacgtacggttacgtaacttacttaacgtaaacgtacggaaacgtacgtacccgtagaacggaacgaccggtaacgtacggaaccgtaaccgggtaccgttagttaagttaacgtgttagggtacgttaaggtaactaaacgttaaacgtttaccgaacggtaacccgggtaccgggggtaaccaaaccgtaaacgttacgtaaccgttaacgggtaacccggggg

SEQ ID NO: 366998 - DNA, 618 bp, Homo sapiens
  misc_feature: GZ8MTXP01CD4PH.22.11.A11.1.454.CMB.2.raw
  modified_base (390)..(390): a, c, t, g, unknown or other
  modified_base (418)..(418): a, c, t, g, unknown or other
  modified_base (458)..(458): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtcctgagactctcctgtgcagcctcgtcgggttccaccgtcaggtagcaagtacatggagtcgtcgggtcccgccgagggctccggaagggggaagggggctgggaggtggatcgtactaggtttattagtcgtccggtaggtaacactatactaacgacngacgtccggtgggcggccgtacttcacntcacgagacgacaacttaccaaagacacggttaatcttanaaagtcggaaaccggcctaggaacgacgcccgagtacgactaccgggtcctagttactaacgtggttgtaggactaacgtaacaaaacgttcccgacggtccccggggacgggtaaccaaccccggttaaagttccggaaccgttcgggtaacccggggg

SEQ ID NO: 366999 - DNA, 790 bp, Homo sapiens
  misc_feature: GZ8MTXP01ANX35.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagacaagtacatgagcgtcgggtccgccgaggccgtaccggaagggggaagggggtcgtagggaggtgggaattccgtacgttaagtttagttttacgtccgttcccgggttaggtaaacacctaataaccgttaaccgactaacggtaaccgtccgggtagggacggggtacccgtattaccaaccctattcccacccaagggaacgtaacctaaacgtttaaccccgaaaaggtaaaccccgtaggggtttacgttaaactttacctttaaacccaaaaaagtttacggggaaaaaccgacgggtacccgttaaggggaaaccgacgggtaccccggaaagttaccggaaacccgtaaccgggggtcccgtttaggtttaaactttaaccggtgggttacgggtaggaaagtaaacttaaaccgttaaaaacgtttccgaaaaccggggtcccggggtaccgggggtaacccaaacccgtaaaagtttccggaaacgttaaccgggtaaccgggggg

SEQ ID NO: 367000 - DNA, 657 bp, Homo sapiens
  misc_feature: GZ8MTXP01AIGX8.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgactccagccgtgggggtccctgacgactctctgtgcagcctcgtggtcacgcagtagcaagtacatggagtcgtcgggtcccgccgaggcctaccggaagggggtaacgggggcgtaggggaacggtgggacttcgttacgtagtttactttacgtcgtgggtacgtaacactaaactactcgcacgaccgtccggtgggacggccgtattccactacgtctaccgagtacgaactaacgttacaaacgaacgacggtatactacgttacaaattacggaacacggtacctaggagacgtaccggatccggaacgtaccgggtaccgttgttaaacgttcgttgggttagttacgaaggttaacttaacgttaaaaacgttcccgaaacgggtcccgggtaacgggggtacccaaacccgtaagttccggtaaacccggg

SEQ ID NO: 367001 - DNA, 598 bp, Homo sapiens
  misc_feature: GZ8MTXP01CRWEN.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtgggtccgccgaggctccgaggggaaggggctgggagtggatctagtagttatttatcgtccggtaggtaaacactaatacctaacgcaagtactcccgggtgggacgggcccgattcgaccctatctaccagagacaacttacaaacgaacacggtagtatacttacaaatggaaacagcctagagacgccgatcgacgtacggccgtgtattaactgttggtagagtaactacttaaaacgttcgaaacggccgggtaccgggggtaaccaacccgtaaagttacgtaaccgttaacggtaaccggggg

SEQ ID NO: 367002 - DNA, 622 bp, Homo sapiens
  misc_feature: GZ8MTXP01BUL88.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcacgcctcgtgggttcaccgtcagtagcaagtacatgagcgtgggtccgccgaggctccgaggggaagggctaggaatggatctctagtttattagtcgtcggtacggtaacacgtaataccgtaaacgcctaaggaccgtccgggtgggacgggtccgtattccgaccactctaccgagacgaacaattaccgaaacgaacgacgtagtactctacaaacgtaggaacacgaccgtgacgacgaccgagtacgacgtacggccgttacgttattaacgtgttggttagaacgtaactaacttaaaacgttccgaaacggccggtaccgggggtaaccaaacccgtaagttacgtaacgttaacggtaaccgggg

SEQ ID NO: 367003 - DNA, 570 bp, Homo sapiens
  misc_feature: GZ8MTXP01AUDN6.22.11.A11.1.454.CMB.2.raw
  modified_base (301)..(301): a, c, t, g, unknown or other
  modified_base (349)..(349): a, c, t, g, unknown or other
  modified_base (354)..(354): a, c, t, g, unknown or other
  modified_base (368)..(368): a, c, t, g, unknown or other
  modified_base (404)..(404): a, c, t, g, unknown or other
  modified_base (434)..(434): a, c, t, g, unknown or other
  modified_base (454)..(454): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagacgtggaggagccttgactccgagccgtggggggtccctgagactctcctgtgcagtcctcgtgggtcacgtcagtagacaagtacatgagcgtcgggtccnccgaggcctccggagggggaacggggctgggagtggattctctagttnttacncgtcggtagtaacncaatactcgcagacgtcggtggacgggctatcactntcacagagacaacttccgaagaaccaggtnactctacaatgaacagtccngaacgcgaccgtagtcgaccgacggtccgtaagtacttacgtggttgtaggaattacttacgttaaacgttccgaacgggtccggacggggtaccaacccgtaagttcgtaaccgg

SEQ ID NO: 367004 - DNA, 658 bp, Homo sapiens
  misc_feature: GZ8MTXP01BITQV.22.11.A11.1.454.CMB.2.raw
  modified_base (467)..(467): a, c, t, g, unknown or other
  modified_base (529)..(529): a, c, t, g, unknown or other
  modified_base (558)..(558): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcacgcctcgtgggtccaccgtcagtagcaagtacatggagcgtgggtccgcgaggctccgaggggagggcgtgggagtggatctagtagtttattcgtcgtcggtagtaacactactacgtaacgcaacgtaccgtcgggtacgggacggacgtactaccactgtcctacggagaacactaacttaaccgaaagtaacgacggttatactacgttaaanaaaacgttcgaaaccgtggtaccagggacgacccggctaaggaccggacgtccccggggttntttaagttaactttgtaggcgggttaaanaacgtaaacgtaaaccgttaaaccggttccggaaccgggtcccggggtaaccggtaacctaaaccgtacgttaccgggtaaccggttcggggaacccggg

SEQ ID NO: 367005 - DNA, 727 bp, Homo sapiens
  misc_feature: GZ8MTXP01A3UEG.22.11.A11.1.454.CMB.2.raw
  modified_base (404)..(404): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgagccgtcgggggtccctgacgactctcctgtcgcacgcctcgtcggtcaccgtcagtagcaagtacatgagcgtcgggtccgccgaggccgtccggagggggagggggcgtagggagtggagttctcgtagtttatttactcgtcggtagtaacactaaactactaacgcacgaccgtccggngggacgggccgtacttccacctactacctaccgaagacgaaacctaacgttaccgaaacggtaaccgacgggttacgtaacttaacccgtttaacgaaaaacttcgggaaaacctacggtacccgttaagggaacggtaacggaaccccggtaagttaccgggaaacccgtacccggggttcccggttaaggtttaaacgtttaccggttagggttacggtaggtaaacggttaacgttaaaccttaaaaacgtttccccggaaacgggtcccggggtaccgggggtaaccttaaaccccgtaaagttaaccggtaacccggg

SEQ ID NO: 367006 - DNA, 805 bp, Homo sapiens
  misc_feature: GZ8MTXP01BF06V.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagtcttgggttttccttgttgcttatttcaataggtgtccagtgtgaggtgcagcgtggtggagacgtggaggagccttgactccgacggtccggttcggggggtccctggacgactctccgtgtgcacgcctcgtcgggttccaccgtcagtagacaagtacagtggagccgttggggccccgcgacgggccgtaccggaaggggggaagggggtccgtagggggtacggttacgggtacttaccgttacgttaaggttttaacttttaacgtccccggttacggggttaacgtaaaccaacgtacgttaaacccgtaacgcgtaacggtacccgtaccgggtaggggacggggtcccgtaacttacccaacctattacccgtaccgaagaaacgaactaaaccttaccgaaaagtacccgtagggttactaacttaccttaacgaaaggttacgaaaaccgtacgtcccgtaaggaaccgtaacggacccggtaagttaccgggaacccgtacccgggttaccgttaggttaacctttaacggttgggttaacgttgggtaaactaacgttaaaccgttaaaaacgttcccggaaacgggggtccccgggtaacgggggttaccccaaaaccggtttaaagtcggttaaacccgttaaccggggg

SEQ ID NO: 367007 - DNA, 677 bp, Homo sapiens
  misc_feature: GZ8MTXP01EL8RJ.22.11.A11.1.454.CMB.2.raw
  modified_base (268)..(268): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagtttggctgagctgggttttcctgttgctatttcaaaggtgtccagtgtgaggtgcagctggtggagactggaggagccttgatccgagccgtgggggtccctgacgtactctccgtgtgcagcctcgtggtcaccgnagtagcaagtacagtgagcgtcgggtccgccgtaggcctaccggaaggggagggggcgtgggagtggattctcgtagtttatttacgtcgttacgggtaggtaaccacgtaaacttaccgtaacggacgacggtacctccgggtgggacggtccgacccgtacttccaacctactcctacccaagtaacgaacctaactaccaaaggaaccgacggttatacttacgttaaacaaactacggtaaacacgtaccgtaggaaggaccgccggactacggaccgaccgggtaacccggttagttacgtttaccgttggtacgggttagaaggttacttaacccgttaaaacttacccgaacgggtcccggggtacgggggttaccctaaaccccgttaagtttaacccggg

SEQ ID NO: 367008 - DNA, 645 bp, Homo sapiens
  misc_feature: GZ8MTXP01B7OLU.22.11.A11.1.454.CMB.2.raw
  modified_base (470)..(470): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtgggaggagccttgatccgagccgtgggggtccctgagactctcctgtgcagcctcgtgggtcaccgtcagtagcaagtacagtgagcgtgggtccgccgaggcctccggagggggaacgggggctagggagtgggatcgtacgtagtttatttagtccgtcgggtaggtaacactaatactaacgacaaggtacctccgggtagggacgggcccgtattccaacctactcctccaagagaacctaattaccgaaagaacctacgggtntactacttacaaattacggaacacgtcctagagacgccgatcgactacgggtccgtagtagttaacgtgttggtgaagtactaacgttaaaacgttccgaaacgggtcccgggtacgggggttaacccaaacccggtaaacgttacggtaacccgtttaacggtaacccgggggg

SEQ ID NO: 367009 - DNA, 760 bp, Homo sapiens
  misc_feature: GZ8MTXP01A1S2E.22.11.A11.1.454.CMB.2.raw
  modified_base (235)..(235): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtcccngagctctcctgtgcacgcctcgtgggtccaccgtcaggtagacaagtacagtgagtcgtcgggtccgccgaggcctaccggagggggaacggggtctagggagtggatccgtgtagtttatttcgtcgtacggtaggtaaaccacgtaaacttacctaacgaccgaaggtacccgttccgggtaggggacggggcccgttaattacccgacctacttccctaccgaacggacgtaacctaaacttaacccgaaacggtaaaccgtaaccgggttacgttaacgttaacctttaaccggtaaaagttaaccggaaaccgtaccggaccccgtaaggaaccggacggtaacccggacgttacggaacccgaccggggtacccgttaaggttaacgtttaaccgtcgggttacggtaaggtaacggttaacgttaaccgttaaaaaccgtttaacccggaaccggtaaccccgggggtaaccgggggtacccttaaaccccggtaaaacgtttccggtaaaccccggg

SEQ ID NO: 367010 - DNA, 577 bp, Homo sapiens
  misc_feature: GZ8MTXP01C0I19.22.11.A11.1.454.CMB.2.raw
  modified_base (249)..(249): a, c, t, g, unknown or other
  modified_base (339)..(339): a, c, t, g, unknown or other
  modified_base (416)..(416): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgatccagccgtgggggtcctgagactctcctgtgcngcctgtgggttcaccgtcagtagcaagtacatgagccgtggtccgccaggctccgaggggaagggctgggagtggatctctagttattancgttcggtaggtaacagataacctaacgcaagactccgtggacgggccattcaccatcacagacgacaattaccaanaacgacggtatatacttacaaatgaaacacgaccagagagaccgagacgacgacggccgtaggtataatgttgtagagaatacttaaaacgttccgaaacggccgggtaccggggtaacctaaccccgtaaagttacgaaccgttaacggtaacccggggg

SEQ ID NO: 367011 - DNA, 586 bp, Homo sapiens
  misc_feature: GZ8MTXP01EP1T5.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagactggaggagccttgatccagccgtgggggtccctgagactctcctgtgcagcctcgtgggttcaccgtcagtagcaagtacatgagcgtgggtccgccaggctccgagggggaagggggctgggagtgggatcgtctagttattatcgtcggtaggtaacacatactaacgcaagactccggtggacgggccgtatcaccatctccagacgacaattaccaaagaacacggtagtatcttaacaaataggaacacgcctaggagacgccgagtacgactacggccgtgtattaacgtgttggtgagtactaacaaacgttccgaacggtcccgggccgggggtaaccaacccgtaaagttacgtaaccgttaacggtaaccggggg

SEQ ID NO: 367012 - DNA, 614 bp, Homo sapiens
  misc_feature: GZ8MTXP01AK7C6.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtggggggtccctgagactctcctgtgcagtcctcgtgggttccaccgtcagtagcaagtcatgagcgtgggtcccgcgaggcctaccggaggggaacggggctgggagtgggatctgtagttatttactcgtccggtaggtaacactatacgtaacgcaagcctcgggtgggacggtccgattccgactatctaccaagacgaacaattaccgaaagtactacgggtataattactacaaagtcggaaacacgtcctagacgacgaccgagtacgacgtacggtccgtagtaatcgtgttgtagagtaactaacttaaacgttccgaaaggtcccgggtacggggtaaccaaacccgtaagttaccggtaacgttaaccggtaaccggggg

SEQ ID NO: 367013 - DNA, 828 bp, Homo sapiens
  misc_feature: GZ8MTXP01CT0G4.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagtctgggttttccttgttgctatttcaaaaggtgtccagtgtgaggtgcagctggtggagacgtggaggagccttgatccgaggccgtgggggtccctgagactctctgtgcagcctcgtgggttcacgtcagtagacaagtacatggacgcgtcgggtcccgccgaggccgtaccggagggggaacgggggtcgtggggtaggtggtacgttctacgttaagttttatttaacgttccggtacgggttacggtaaaccaccgtaaaacttaccgtaaccgacgtaacggaccgttacccggggtaggggaacggggtacccgtaacttcccgtaacccgtaacgttacccgttacccgaaaggaaccggtaaaccttaaaaccgtttaaccccgaaaacggtaaacccggttaaccggggttaacggtttaaactttaacccggttttaaacgtaaaacgtttacgggtaaaacccaacgggtaccccgttaggaaacggacggaccccggtaagtaccgggaacccgtaccggggtcccggtttaaggttaaccgtttacgtagggttaggttaaggacggttaaacgttaaccgttaaaaccgtttaacccgggaacgggtaaccccggggtaccgggggttaccccttaaaacccggttaaacgtttaaccgggtaaacccgg

SEQ ID NO: 367014 - DNA, 655 bp, Homo sapiens
  misc_feature: GZ8MTXP01A2X90.22.11.A11.1.454.CMB.2.raw
  modified_base (296)..(296): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagctctcctgtgcagcctcgtgggttccaccggtcagtagcaagtacatgagcgtgggtccncaggctccgaggggagggctggagtggatctctagttattatctcggtagtaacactatactaacgcaacgactccggtggacgggccgattcacctatcctaccagacgactaacttacccaaagtaacgtaccgggttatacttaccgtttaaacaaagttacgggaaacctacggtcccttaagggaacggaccggtacccggaagttccggaaccgtaccgggtacccgttaggttaacttaaccgttggttaggttagaacggtaactaaacgttaaaacgttcccggaaagggccccgggtacgggggtaacccaacccgtaagttacgaaccgttaacgggtaacccggggg

SEQ ID NO: 367015 - DNA, 706 bp, Homo sapiens
  misc_feature: GZ8MTXP01C5TS5.22.11.A11.1.454.CMB.2.raw
  modified_base (278)..(278): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtgggaggagccttgatccaggccgtggggggtccctgagactctcctgtgcagcctcgtgggttcaccgtcagtancaagtcatgagcgtgggtcccgcgaggctccggaggggaggggctgggagtggtatcgtactagtttatttagtcgtccggtaggtaacactaataccgtaacgcaacgaccgttccgggaggggacgggacccgtattacccacccgtattcccgaccgaaaggtaacgaaccttaaacgttaccccgaaaaggtaaccccgtaggggttattaacttaccctttaaacgaaaagttacggggaaaacacgggtaccctagggaaacggtaccgcccggtaagtaccggaaccgtaccggggtccccgttagtttaacttcgtggttaggtagaagttaactaaccgttaaaacgttccgaaaccgggtcccggggtacgggtaacccaaacccgtaagtttcgaaccgttaacggggtaaccgggg

SEQ ID NO: 367016 - DNA, 735 bp, Homo sapiens
  misc_feature: GZ8MTXP01CNCG4.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagctggtggagacgtggaggagccttgactccgagccgtcgggggtcctgagctctccgtgtgcagcctcgtgggttcaccgtcagtagacaagtacagtgagcgtcgggtccgccgaggctaccggagggggaaggggcgtagggaggtggtactcgtacgtaagtttaatttacgtcgttccggtaggtaaactacgtaactaaccgtaacggccaaggtacccgtccgggtaggggacggggtcccgtaactttccaacccgtactttccgaccgaaaggtaacgaaacctaaacgttaacccgaaaacgtaacccgtaacggggttaattaacttaccgtttaacgaaaacgttacggggaaacgtaacggtcccgttaagggaaaccgaacggaccccgtaagttaccggaaccgtaccgggtaccgttaggtactttaacgtggttaggtacgagtaaactaacttaaaacgttcgaacgggtaacccgggcgggtaaccaaacccgtaagttccgtaacgttaacgggtaacccgggg

SEQ ID NO: 367017 - DNA, 638 bp, Homo sapiens
  misc_feature: GZ8MTXP01CPTFU.22.11.A11.1.454.CMB.2.raw
  modified_base (358)..(358): a, c, t, g, unknown or other
  modified_base (385)..(385): a, c, t, g, unknown or other
  modified_base (409)..(409): a, c, t, g, unknown or other
  modified_base (465)..(465): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgaggccggtcgggggtccctggacgtactctccgtgtcgcagtcctcgttcggggttccacccgtcaaggtacgacaaagtacagtggagtccgtcgggtcccgcgaggcctacggagggggaaggcgtggagtggatctntaagttattactcgtcggtacgtaacncatacgtaacgcaacgacgtcggnggacggccatcgacatccacagacgacaattaccaaagacgacgtatatccttaanaaatcggaaacgtagtccaagacgacgacccggatacggaacctccgggtaccgttgttaagttcgtggttcgttaaggactaaacggtaacttaaaacgttcccgaaacggccgggtaacccggggttaaccaaaacccggtaattcggaacccgttcgggtaacccggggg

SEQ ID NO: 367018 - DNA, 681 bp, Homo sapiens
  misc_feature: GZ8MTXP01A1KI2.22.11.A11.1.454.CMB.2.raw
  modified_base (263)..(263): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagcgtggtttcgtgtagctattcaaaaggtgtcagtgtgagtgcagctggtggagactggaggagccttgatccagccgtgggggtccctgagactctcctgtgcagcctctgggttcacccggtnagagactaagtacagtggacgtcgtcgggtcccgaccgacggccgtacgggaagggggaacgggtcgtagggaggtaggattcgttacgttagtttatttacgtcgtaccggttacgtaaactacgtactaaccgaacgacgtaacgaccgtccgggagggtacggtaccgtactaccaacctactaccgaccgaaagaactaactaaacgttaccgaaacgtaacgtacggttagttaacttaccttaacaaaagtaacggaacgacgacgtacgacgacgacgacgacgacgtacggtacgtacgttagttaacgttgttggtagagtaacgtaacgttaaacgttaccgttacggtaacccgggtaccgggtaacccgtaaccgtaacgttacgtaaccgttaacggtaaccggg

SEQ ID NO: 367019 - DNA, 804 bp, Homo sapiens
  misc_feature: GZ8MTXP01DMPK3.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagtcttgggttttccttgttgcttatttacaaaaggtgtccagtgtgaggtgcagctgggtggagacgtggaggagtccttgactccgaggccggtcgggggtcccctggacgtactctcctgtgcacgtcctcgtcgggttcaccgtacagtagactaagtacagtggacgtcgtcggggtcccgaccgacgggccgtaccgggaagggggaacggggtcgtagggaggttcgggtatcgttacgttagtttacgtttagtacgtttcggtaacggtaacaacgtaacttaacccgtaaccgtacgtaacggtacccgtaccgggtacggggacggggtacccgtagttacccaaccgtactacctaccggtaagaacgtaactaaaaccgttaccgaaaacggtaaaccgttacgggttagttaaacctcctttaaaacgtaaacgttacggggaaaaccgtcggtaaccgtacggggaaacgtaaccggtacccgtaacggtacggtaaacccgtacccgggttacgttacggtttaacgtttaaccgtaggttagtacgaaacggtacttaaaccggttaaaacgtttcccgaaacgggtccccgggtaacggggtaaccaaacccgtaaggtttaccgaacgttaaccgggtaacccgggg

SEQ ID NO: 367020 - DNA, 806 bp, Homo sapiens
  misc_feature: GZ8MTXP01AU4A4.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaagtgtcagtgtgaggtgcagctggtggagacgtggaggagccttgatccgagccggtgggggtccctgagtactctcctgtgcagcctgtcgggttcaccgcagtagactaagtacagtaggcgtacgtcggggtcccgaccgtagggcctaacccggagggggaaacgggggtccgtggggaaggttacggggaactttcgtaccgtaagtttttactttacgtccggttacggggtaggtaaaccacgtaaacgttaacctaacggccaaacgggtacctcccggggttgggaacggggacccgtaaagtcccaacgtacttaccgtacccgaagacgaaaccttaaacgttaaccgaaagtaaaccgacgggttacgtaaacgtttacccgtaaactaaaaggtaaccgttaaaccgtaaaccgtcccggtaaggaacgtacgggtaaccccgaagttaccgggaaacccggtacccggtacccggttaacgtttaacgtttaacgtggggttacgtaagggttaaacaaccgtttaaaccgttaaaaacccggtttcccgaaaaccggggtcccgggggttacccgggggtaacccttaaaacccttaaacgggttaacgttaaaccccgggg

SEQ ID NO: 367021 - DNA, 599 bp, Homo sapiens
  misc_feature: GZ8MTXP01EF97C.22.11.A11.1.454.CMB.2.raw
  modified_base (463)..(463): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatgaagttttggctgagctgggtttccttgttgctatttcaaaaggtgtccagtgtgaggtgcagctggtggagacgtggagagccttgatccagccgtgggggtccctgagctctcctgtgcagtcctgtgggttcaccggtcagtagcaagtcatgagcgtgggtcccgcgaggcctaccgaagggggaagggctgggagtgggaatctcgtagtttattagtcttccggtagtaaacacgtatacctaacggcaaggaccttcgggagggaacggggtcctattcaaccctatctaccagagacaattacccaaagaacacggtataatccttaaanaagtaggaacacgccgagacgacgacgagtacgacgtacgtcgttatactaagtgttgtagaagtaactaacttaaacgttcgaacggtccgggtacgggtaacccaacctaagttacgtaacgttaacggtcggg

SEQ ID NO: 367022 - DNA, 878 bp, Homo sapiens
  misc_feature: GZ8MTXP01AWD7Q.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtgggaggagccttgatccgagtccgtggggggtccctgacgactctcctgtgcacgtcctcgtcgggtcacgacagtacgctaagtacatggacgcgttcggggccccgaccgagggtccgtaccggaaggggggaaacgggggtccgtagggggaggttcgggaactttccgtacgttaaaggtttttaactttttaaccgtccggtttacgggggttaacggttaaaaccctaacgtaacgtttaaaccgaacccgccgtaaacgggtaacccgtttcccgggggtagggggaaccggggtacccccggtaaacgtttacccgaaacccctaaacgtttcccctaacccgtaaaggaaccgggtaaaaccctaaaaccgttttaaccccggaaaacggtaaaacccggtaaccgggggtttagttaaaccgtttaccgtttaaaaccgttaaaaacgttacggggtaaaaccctaacggtaccccgtaagggaacggtaaccggacccggttaaagtaccggaaacccggtaccggggtacccgttaagttaaccgttttaacggttgttaggttacgaaggttaacgttaaccaaaaccgtttaacccgggaaacggtcccggggtacgggggtaacccttaaaccccgtaaaggttttcggtaaacccggg

SEQ ID NO: 367023 - DNA, 692 bp, Homo sapiens
  misc_feature: GZ8MTXP01DBCQI.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctggttttcttgttgctattcaaaaggtgtcagtgtgaggtgcagctggtggagacgtggaggagccttgactccgaggccggtgggggtccctgacgactctcctgtgcacgtcctcgtcgggttcaccgtcagtagacaagtacagtgagcgtcggtccgccaggcctaccggagggggaagggcgtgggagtgactctacgtagtttagttagtcgtccggttagtaacactaataccgaaacgcgaacgtaccgtcgggtacggggacgggaccgtacttccaactatacctaccgaagacgaaccaaacttaccgaaagtaacgtacggttaattacttacgttaaactaaagtacggaaacgtacgtacccgtagaagaacggtaccgaagtaccggaactaaccgggtccgttaacgttaagttaacgttggttacgtaaggaaacgtaacgtaaacttaaaacgttccggaaacgggtcccgggtaccggggtaacctaaaaccccgtaaggttaccggtaacgttaacggggtaacccggggg

SEQ ID NO: 367024 - DNA, 629 bp, Homo sapiens
  misc_feature: GZ8MTXP01ASEDW.22.11.A11.1.454.CMB.2.raw
  modified_base (302)..(302): a, c, t, g, unknown or other
  modified_base (526)..(526): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccgagccgtgggggtccctgagactctcctgtgcacgtcctcgtgggtcaccgtcagtagacaagtacatgagcgtcggccgccgnggctcggaggggagggcgtggagtggattcgtactagtttattagtcgtcgggtagtaacactaataccgtaacgacgaacgaccgtcggtagggacggcgtacttccaccgactcctaccgaagacgaactaacgtaccgaacgtaaacgtaccggtattactacttaacaaatacggaacacgtaccgtagacgacgcgatacgacgtacggtcgtacgttnttaacgtgttgtagagtaactaacgttaaaacgttcccgaacggaacccgggtaccggggtaaccaacccgtaagttaccgtaaccgttaaccggaaccgggg

SEQ ID NO: 367025 - DNA, 749 bp, Homo sapiens
  misc_feature: GZ8MTXP01EGAKU.22.11.A11.1.454.CMB.2.raw
  modified_base (272)..(272): a, c, t, g, unknown or other
  modified_base (277)..(277): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctattcaaaaggtgtccagtgtgaggtgcagctggtggagacgtggaggagccttgatccgaggccgtgggggtccctgacgtactctcctgtgcacgtcctcgtggtcacgtnagtanacaagtacatggagcgtcgggtccgcgagggcctacggagggggaacggggcgtagggtagtgggaacttcgttacgttaagtttagttacgtcgtaccggtacggtaaacaacgtaactaaccgtaaacgacgaacgtacgtccgggtacggggacgggtaccgtaacttaccaaccctataccctacgaaggtacaacctaaatttaaccccgaaagtaaaccgtacgggttagttaacttacccttaaagtaaacgttacgggaaaccgacgttacccgttaggaaccggtaccgacccggttagtaacggaacccgtaccggttacccggttaattaccggttaacttagggttggtagaaacgtaactaaacccttaaaaacggttcccgaaacggggtaaccccggggtaccgggttaacaaccccggtaaaggttaccgtaacggttaaccgggtaacccggggg

SEQ ID NO: 367026 - DNA, 883 bp, Homo sapiens
  misc_feature: GZ8MTXP01BI7WR.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggtttttccttgttgcttatttacaaaaggtgtccagtgtgaggtgcagcgtggtggagacgtggaggagccttgatccgaggccggtcgggggtccctgacgtacctctccgtgtcgcgacgtcctcgtcgggttcacccgtcaagtagaccaaagtacagtggacgtccgtcggggtcccgaccgacggtcccgtaccggtaagggggaacgggggtccgtaggggtacggtgggtacttccgttacgtaaggtttttacttttacgttccggttacgggttacggtaaacctaacaaacgttaacgtaaccgacaacggtaccgtaccgggtaggggacggggtaccgtactttccaacctactccgtacgacggaaacgtaaacctaaacgttacccgaaaacgtaaccgtaacggggttacttaacctttaccgttaaaccgtaaaaggttaaccggaaaccgtaacggtaccccggttaaggaaaccgggtaaccggaacccgggttaagtacccgggtaaaccccgtaaccgggggttccccggtttaaagtttaaaccggtttaccgggtttacgggttaaaggttttaacgggaaacgggttaaacctttaaacccggttaaaaaaccgtttccccgggggaaaaaccgggtcccccggggggttaaccggggggtaacccccttaaaaacccggttaaaccggtttaaccgggttaaaaccccgggg

SEQ ID NO: 367027 - DNA, 830 bp, Homo sapiens
  misc_feature: GZ8MTXP01AF3OD.22.11.A11.1.454.CMB.2.raw
  modified_base (312)..(312): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagtcttgggtttttccttgttgcttatttcaaaaggtgtccagtgtgaggtgcagcgtggtggagacgtggaggagccttgatccgaggccgtgggggtccctgacgactctctgtgcagcctcgtgggtcaccgtcagtagcaagtacatgacgctcggggtcccgaccgnggcctaccggaagggggaacggggggctgggggaaaggttcgggtaacttccgttacgtaaggttttaatttaccgttaccggttacggggttaacggtaaaaccctactaaaacttaaccgttaaccggctaaacgggtaacccgttcccgggtagggggaaccgggggtacccccgtaaattaccccgaaaccctaaccgttacctacccgaaacgaacgtaaaccctaaaacgtttaaccccggaaaacggtaaacccgttaaacggggttaacgttaacgttaaccgtttaaaccaaaagtttaacggaaaccgttaaacggaaccccgttaggaaacggaaccggtaccggaagttacggaaacccgtaccggggtacccggttaagttaacgtttaaccggtaggtttaggtaaggtaagttacgttaaacgttaaaaaccgttaaccgaaacgggtcccgggtaccgggggtaacccttaaaccccgttaaaagttccggttaaacccggg

SEQ ID NO: 367028 - DNA, 667 bp, Homo sapiens
  misc_feature: GZ8MTXP01AXZAJ.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgactccgagtccgtgggggtccctgacgtactctctgtgcagcctcgtggtcaccgtcagtagcaagtacagtgagcgtcgggtcccgccgaggccgtaccggaagggggaacggggcgtgggagtggatctactagtttatttacgtcgtacggtaggtaacacgtaataactaacgacacgtaccgttcggtaggggtacgggccgtacttcccgaacctactaccgtacccgaagtaacggaaactaaaccgtttaaccgaaacggaaaccgtaacgggttacttaattacctttaacaaaacgttacggaaacctacggtacccgtaggacgacggacccgtagtacgaccgtaccgggtcctaagtacttagtgttaggtgaagacgttacaaaacgttcccgaaggcccgggacggggttaccaacccgtaagttcgtaacccgg

SEQ ID NO: 367029 - DNA, 811 bp, Homo sapiens
  misc_feature: GZ8MTXP01CLF6D.22.11.A11.1.454.CMB.2.raw
  modified_base (276)..(276): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgatccgagccgtgggggtccctgagactctcctgtgcagcctgtcgggttcaccgtcagtanacaagtacagtgagtcgtgggtcccgcgagggcctaccggaagggggaacgggggtcgtaggggaggttgggatcgttcgtaagtttagtttaacgtcgttacccggttaggtaaaacctcgtaaacttaaccgtaaccgactaacggtacgttcccggggtaggggaccggggtacccgtatttacccaacccgtattcccgtaacccgaaggtaacgtaacctaaattaccccgaaaaggtaaaccgtacggggttaattaacttaccttaaaccaaaaagttcgggaaaaccgtaacggtcccgttaacggaaaggaacggaaccccgttaaggtaacgaaccggtaacccgggggttacccgttaagggttttaaaacccttaacggttgggttaacggttaagaaacggttaaaccttaaaccggttaaaaaaccgttcccgaaaccggggtaaccccgggtaacgggggtttaaccccaaaacccgtaaaagtttccccgggaaaccgttaacgggtaaccccgggggg

SEQ ID NO: 367030 - DNA, 598 bp, Homo sapiens
  misc_feature: GZ8MTXP01AXFCS.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgacgactctctgtgcagcctcgtgggttcaccgtcagtagcaaagtacatgagcgtgggtcccgcgacggctaccggagggggaacgggggctagggagtgggattccgtagtagtttatttacgtcgtcggtagtaacacaatactcgcagactccggtgggacgggctattccactatcctacagagaactaacttccaaagaactacggtatactaccgttaaacgaaagtacgaacacgtacgagacgacgacgacgtacgaccgtacggtcgttaagttacgttagtgttagtagaattaacgttacgttaaacgtcgaacggtccgggacgggtaccttaaccgtaagttcgtaacg

SEQ ID NO: 367031 - DNA, 714 bp, Homo sapiens
  misc_feature: GZ8MTXP01AU01I.22.11.A11.1.454.CMB.2.raw
  modified_base (625)..(625): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagtcttgggttttccttgttgcttatttcaaaaggtgtccagtgtgaggtgcagcgtggtggagacgtggaggagtccttgactccgacggtccggtgggggtccctgacgtacttccgtcctgtcgcacgtccttcgtcggttccaccgtcagtacgacaagtacagtggacgcgtcggtcccgccgaggccgtaccggagggggaacggggtcgtagggaggtggtattcgtagtacgtttatttactcggtacggtagtaacctacgtaaactaccgtaacgcgaacgtaccgtcccgggtagggaccgggtacctacttacccacgtaacgttcctaccgaacgtaacgtaaacctaaacgttaccgaaaacgaacgtacgggttacttaacgttacctttaacgaaaacgttacgaaacgacgtacgtaaggacgacgaccgtagtacggactaccgggtcgttaagttaacgtttacgnggttcgtaagaacgttaacgttaaccttaaaacggttcccgaacgggtcccggtacgggggttaccaacccgttaagttcggtaaccgg

SEQ ID NO: 367032 - DNA, 596 bp, Homo sapiens
  misc_feature: GZ8MTXP01D6YMK.22.11.A11.1.454.CMB.2.raw
  modified_base (351)..(351): a, c, t, g, unknown or other
  modified_base (446)..(446): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtggtggagactggaggagccttgatccgagccgtgggggtccctgagactctctgtgcagcctcgtgggttcaccgtcagtagacaagtacatgagcgtcgggtccgcaggcctccgaagggggagggctgggagtggatctacgtagttactttancgtggtagtaacacaatactcgcaagccgtcgagggacgggcctattccacatcaccaagacgaactaactacaagaacacggtataatcctaanaaatagaaacagaccgagacgagacccgatacgacgtacggccgttaagtacgttagtgttagtaagtaggttaacgaaccttaaaacgttccgaaacggtcccgggtaaccgggggtaccaaaccccgtaaagtttccggtaaacccgg

SEQ ID NO: 367033 - DNA, 586 bp, Homo sapiens
  misc_feature: GZ8MTXP01CEY6X.22.11.A11.1.454.CMB.2.raw
  modified_base (453)..(453): a, c, t, g, unknown or other
  modified_base (498)..(498): a, c, t, g, unknown or other
  modified_base (504)..(504): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcacgcctcgtgggttcaccggtcagtagcaagtacatgagcgtgggtccgccgaggcctccgaggggaaggggctgggagtggatctctagttatttagtctcggtggtaaacactataaccgtaacgcaaggactcccgggtgggagggcctagttccaccactcctaccgagacgaacaattaccgaaagaaccaggtgtactnttacaaatcgaacagcctgagacgaccgatgactacggccttgtnttaacngttcgtagagaactaggaaaacttcaacggccggacgggggttaacaacccgtaaagttcgaacgttaacggtaaccggggg

SEQ ID NO: 367034 - DNA, 725 bp, Homo sapiens
  misc_feature: GZ8MTXP01DJBYC.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtcagtgtgaggtgcagcgtggtggagacgtggaggagccttgatccgaggccgtgggggtccctgagactctcctgtgcacgcctcgtgggtccaccgtcagtagacaagtacatggagcgtcgggtcccgccgaggccgtaccggagggggaagggggcgtgggaggtggtattcgtacgtagtttactttacgtccgtacgggtaggtaaaccactaaacttaaccgtaacgactaacggtaccgtccgggtaggggaacggggtcctaactttaccaaccgtactaccgtacccgaaggacgaaactaacgttaaccgaaacgtaaaccgtaccgggttagttaacttacttaaacgtaaaacgttacgaaaccgtaacggtacccgtaaggaacgtaacggaccgtaacgtacggaaaccgtaccgggtaccgttaagttaacgttacgttggttagtaacggaagttaaacttaccgttaaaacgttcccgaaacggtcccgggtaacggggtacccttaaaccgtaaacgtttcggtaaacccgg

SEQ ID NO: 367035 - DNA, 629 bp, Homo sapiens
  misc_feature: GZ8MTXP01BDQB5.22.11.A11.1.454.CMB.2.raw
  modified_base (250)..(250): a, c, t, g, unknown or other
  modified_base (267)..(267): a, c, t, g, unknown or other
  modified_base (296)..(296): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggagagccttgatccagccgtgggggtccctgagactctcctgtncagcctcgtggtcacgnagtagcaagtacagtgagcgtcgggtccnccgaggctaccgaaggggagggctgggagtggactctacgtagttaatttactcgtacggtaggtaacacgtaataactcgacagaccgtcggtgggaacggggacctaaactccaactacgtcctaccgaagaacgtaactaaagttaaccaaacgtaacgaccggttataacttacttaacaaaagttacgaaacacgtaccagacgacgtaccgagtacaccggacgccgttaagtatttagtagttagtgaacggttattaaacttaaacgttaaccgaacggcccggggtcggggtacccttaaaccgtaaacgtttcgaaacccggg

SEQ ID NO: 367036 - DNA, 711 bp, Homo sapiens
  misc_feature: GZ8MTXP01BKYUK.22.11.A11.1.454.CMB.2.raw
  modified_base (297)..(297): a, c, t, g, unknown or other
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttacaaaaggtgtccagtgtgaggtgcagctggtggagactggaggagccttgatccagccgtggggggtcctgagactctctgtgcagcctgtcgggttcaccgtcagtagcaagtacatgagcgtcgggtccncgaggcctaccggaagggggaacgggctagggagtggactctactagtttattatcgtcggtaggtaaacactatactaacgcaaggtactacccggtagggacggtccgtaattccgaacctactactaccaagggtaacgaacctaaacgtttacccgaaaacggaaaccctaacgggggttattaacgttaccgtttaacaaaaacgttacggggaaaacctaaccgggacccttagggaaacggtaccgggtacccaagttaccggaaacccgaacggggttccccgttaggtaacctttaaacgtggttacgttaggaagtaaactaaaccggttaaaaaacttccgaaaacgggtcccgggtaccggggaacctaaccctaaaagtttcgaacgttaaccgtcggggg

SEQ ID NO: 367037 - DNA, 597 bp, Homo sapiens
  misc_feature: GZ8MTXP01CGUJD.22.11.A11.1.454.CMB.2.raw
  modified_base (249)..(249): a, c, t, g, unknown or other
  modified_base (256)..(256): a, c, t, g, unknown or other
  modified_base (269)..(269): a, c, t, g, unknown or other
  modified_base (293)..(293): a, c, t, g, unknown or other
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtncagcctntgggttcaccgtnagagcaagacatgagctgggtccncaggctcgaggggaagggctggagtggatctacagtttattatctccggaggtaacacaatacctaacgactaagacttcccggagggacggggcctaattccaaactgttcacccaaggtacaactaattacccaaagaaaccgtaggtagttaatcttacaaaaggttaacggaacacgacgacgagacgacgatacgacgtacgacgtagtattaatgttgtagagtaactaacaaacgttaccgaacggaaccggaccgggtaaccgaaccgtaacgttacgtaacgttaacgtaacggg

SEQ ID NO: 367038 - DNA, 557 bp, Homo sapiens
  misc_feature: GZ8MTXP02HTFPL.22.11.A11.1.454.CMB.2.raw
  modified_base (292)..(292): a, c, t, g, unknown or other
  modified_base (359)..(359): a, c, t, g, unknown or other
tcagacatacgcgtcacgaccggtgctcgatttagctacgactgcaggggggagaggagcccagcactgggattccgaggtgttcccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccncaggctcgaggggagggctgggagtggatctctagtttattatcgtcggtagtaacacatactacgnagactccgtggacggcgattcacatctccagagactaattaccaagaacacggtagtactcttacaaatgaaacagcctagacgacgaccgatcgacgacggtcgtagtacttacgtgtgtagagtactactaaaacttccgaaggcccggtacgggggtaccaacccgtaaagtttacgaacgttacggtaccgggg

SEQ ID NO: 367039 - DNA, 587 bp, Homo sapiens
  misc_feature: GZ8MTXP02ILFV3.22.11.A11.1.454.CMB.2.raw
  modified_base (253)..(253): a, c, t, g, unknown or other
  modified_base (290)..(290): a, c, t, g, unknown or other
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtggggggtcctgagactctcctgtgcagcctntggtcaccgtcagtagcaagtacatgagctgggtccnccaggcctccgaggggaggggctgggagtgggatctcagttattatctcggtagtacacatactacgcagactcggtgggacggccgattcaccatctccagagacaacttaccaacgaacacggtagtatcttaacaaagttacgaaactacgacccttaggaacgacggccgtaagtcgaaccgacggtacccgtgttatttaacgtggttgtaggaagactacgtaaaaactttccgaaacgccggtaccgggggtaccaaacccgtaaattacgaacgttacggtaccggggg

SEQ ID NO: 367040 - DNA, 625 bp, Homo sapiens
  misc_feature: GZ8MTXP02HFM99.22.11.A11.1.454.CMB.2.raw
  modified_base (354)..(354): a, c, t, g, unknown or other
tcagacatacgcgtcacgaccggtgctcgatttagctacgactgcaggggggagaggagcccagcactgggattccgaggtgttcccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagctgggtccgccaggctccgaggggaaggggctgggagtggatctctagtttattatctcggtagtaacanatactacgcagactcgtgggacggccgtatccaccatctccagacgacaattaccaaagaacgacggtagtactcttaacaaattacgaaactacggacctagggaacgacgacccgagtacgaaccgaccgggtacccgttaggttaaacctttaacgtggtggttacggaaaggtaacttaactaaaaacctttccgaaaacggcccggggtaccgggggtaaccctaaaccccgaaaagtttacggaacccgttacggtacccggggg

SEQ ID NO: 367041 - DNA, 525 bp, Homo sapiens
  misc_feature: GZ8MTXP02GC9UC.22.11.A11.1.454.CMB.2.raw
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgccaggctccgaggggaaggggctgggagtgggatctcagttattatctccggtggtaacacatactacgcagactccgtggaggccgattcaccatctccagagacaattaccaagaacacggtgtatcttacaaatgaacagcctagagacgccgatcgacacggccgtgtattacgtgtgtgagatacaaaacttcaagccgcggggtacaccgaatacgactacgtacgggg

SEQ ID NO: 367042 - DNA, 535 bp, Homo sapiens
  misc_feature: GZ8MTXP02HHARR.22.11.A11.1.454.CMB.2.raw
  modified_base (362)..(362): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagctgggtccgccaggctccgaggggaaggggctgggagtggatcgtcagtttattatctcggtggtaacacatacncgcagactccgtgggacggcgatcaccatctccagagacaacttaccaagaacacggtagtatcttacaaatagaacacgacctagacgagaccgatgacacggccgtagtattactgtgtgagactacaaaattccgaacgccggacggggtacacccgtaagtacgtaacg

SEQ ID NO: 367043 - DNA, 514 bp, Homo sapiens
  misc_feature: GZ8MTXP02JMDBH.22.11.A11.1.454.CMB.2.raw
  modified_base (453)..(453): a, c, t, g, unknown or other
  modified_base (461)..(461): a, c, t, g, unknown or other
  modified_base (488)..(488): a, c, t, g, unknown or other
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggtcaccgtcagtagcaagtacatgagctgggtccgccaggctccgaggggaagggctgggagtggatctcagttattatctcggtgtaacacatactacgcagctcgtggacggcgattcacatctccagagacaagtccaagaacacggtgatcttacaaatagaacagcctagagagccgatcgacgacggccgtnaagttacngtgtagagatacaaaacttcaagccgnggggtacacaatcgacgtagtacggg

SEQ ID NO: 367044 - DNA, 304 bp, Homo sapiens
  misc_feature: GZ8MTXP02GF4JI.22.11.A11.1.454.CMB.2.raw
  modified_base (302)..(304): a, c, t, g, unknown or other
tcagacatacgcgtcacgaccggtgctcgatttagctacgactgcaggctgctgatggtgagagtgaattctgtcccatcaaggttcagcggcagtggatctgggacagaattcactctcaccatcagcagcctgcagcctgatgattttgcaacttattactgccaacagtataatacttattcgtggacgttcggccaagggaccaaggtggaaatcaaacgaactgtggctgcaccatctgtcttcatcttcccgccatctgaacgcgtatgtctgagcgggctggcaaggcgcatagnnn

SEQ ID NO: 367045 - DNA, 604 bp, Homo sapiens
  misc_feature: GZ8MTXP02G7JZG.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggtcaccgtcagtagcaagtacatgagcgtcgggtccgccgaggcctaccggaggggaaggggcgtgggaggtggatctacagtttattactcgtcggtagtaacacatactcgcagaccgtccgtgggacgggccgtattccacctatcctaccaagaacgaactaacttaccaaaagaaaccgacggtagttaactcttaacaaaattagaaactacgacctagagacgccgaagtcgaacgacggtccgtagttactacgtgtagtacgagtaactaacgtaaaaactccgaaacggtccggggaccggggttaccaaacccgtaaagtttacggaaacccgg

SEQ ID NO: 367046 - DNA, 575 bp, Homo sapiens
  misc_feature: GZ8MTXP02IGT6F.22.11.A11.1.454.CMB.2.raw
  modified_base (320)..(320): a, c, t, g, unknown or other
  modified_base (329)..(329): a, c, t, g, unknown or other
  modified_base (339)..(339): a, c, t, g, unknown or other
  modified_base (353)..(353): a, c, t, g, unknown or other
tcagacatacgcgtcacgaccggtgctcgatttagctacgactgcagggggagaggagcccagcactgggattccgaggtgtttccattcggtgatcagcactgaacacagaggactcaccatggagttttggctgagcggtggtttcgtgtaggctattacaaaggtgtcagtgtgaggtgcagctggtggagactggaggagccttgatccagccgtgggggtcctgagctctcctgtgcagctctggtcaccgtcagtagcaagtacatgagctggtccgccaggcgtcccagggaaggggcgtggagtgggatctnagtattatntccgtggtanacatacttacgacngactccgtggagggaccggacgttcaccaattctcccaacgaggaacaattacctaaacgaaacaaccggtacggtataccttactaaacttaaagaacgtacgacgtagagacgacgacgtacgacgacgcgtacgtacttacgtgtagtagtagtactaactaaactaacgacgtaaccggtacgggtaccgaaccgtaacgtacgtacgtacggtacgg

SEQ ID NO: 367047 - DNA, 567 bp, Homo sapiens
  misc_feature: GZ8MTXP02JR2OE.22.11.A11.1.454.CMB.2.raw
  modified_base (292)..(292): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccnccaggctccgaggggaaggggctgggagtgggatctcagtttattatctcggtgtaacacatacgtacgcagactccggtggagggccgattccaccatctccagagacaattacaagaacacggtagtatcttacaaatagaacagctagagacgaccgacgtacgacgacggtacgtagtacttacgtgtagtagacgtactaactaaactaccgtaacggaaccggaccggggggaaccaaccgtaacgtacgtacgtacggtaacccgggg

SEQ ID NO: 367048 - DNA, 597 bp, Homo sapiens
  misc_feature: GZ8MTXP02IHP1H.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtgggggtccctgagactctcctgtgcagcctctgggttcaccgtcagtagcaagtacatgagctgggtccgcaggctccgaggggaaggggctgggagtgggatctcagttattatctcggtgtaacactatactacgcagacctcggtggacgggccgtattccaccgatctaccgagagaacaattaccaaagaacacggtgtatactacaaatcgaaactagcctagaagcgaccgatacgacgacggtccgtagtaagttaccgtggtgtacgaagtaacgttaactaaaaacgtttcccgaaacggtcccggggtacgggggtaacccaaccccgttaaaaagttccggaaaccgttaacggtacccggggg

SEQ ID NO: 367049 - DNA, 539 bp, Homo sapiens
  misc_feature: GZ8MTXP02JD4IS.22.11.A11.1.454.CMB.2.raw
  modified_base (375)..(375): a, c, t, g, unknown or other
  modified_base (395)..(395): a, c, t, g, unknown or other
  modified_base (418)..(418): a, c, t, g, unknown or other
  modified_base (426)..(426): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgaggggaaggggctgggagtggatctcagttatttactcgtcggtagtaacacatactcgcagacgtccgnggacgggccgattcacatcncagagacatccaagaacacggtntatcttanaaatgaacagcctgagacgcgatgacacggccgtgtacttactgtgtagacgactactaaaacgtccgaaacggccggtaccgggggtacaacccgtaaagttcgtaaaccgg

SEQ ID NO: 367050 - DNA, 522 bp, Homo sapiens
  misc_feature: GZ8MTXP02FY1WY.22.11.A11.1.454.CMB.2.raw
  modified_base (350)..(350): a, c, t, g, unknown or other
  modified_base (359)..(359): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccgcaggctccgaggggaaggggctgggagtggatctcagttattatctcggtagtaacanatactacgnagactcgtggaggccattcacatctccagagacaataccaagaacacggtatatcttacaaatgaacagcctagagacgcgatgacacggccgtagtattactgtgtgagatacaaaactcaaagccggacggggtacaaccgtaatacgactacgtacgggg

SEQ ID NO: 367051 - DNA, 536 bp, Homo sapiens
  misc_feature: GZ8MTXP02FTN2J.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggtcaccgtcagtagcaagtacatgagcgtgggtccgccaggctccgaggggaaggggctgggagtggatctcagtttatttatcgtcggtgtaacacgatactcgcagactccgtgggacggccgattcaccatctccagagacattccaagaacacgtgtatctacaaatgaacagcctagagagccgaatgacacggccgtagtattacgtgtagtagagtatactaaaattccgaaagcccgggacggggtacaaacccgtaaagttcgaaccg

SEQ ID NO: 367052 - DNA, 531 bp, Homo sapiens
  misc_feature: GZ8MTXP02G94Z2.22.11.A11.1.454.CMB.2.raw
  modified_base (294)..(294): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccnccaggctccgaggggaagggctgggagtggatctcagtttattatcgtggtggtaacacgatactacgcagactccgtggaggccgatcacatctccagagacatccaagaacacgtgtatcttacaaatgaacagacctagagagccgatcgacacggccgtagtagttacgtgttagtagagtactacaaaacttccgaaagccggacgggggtacaacccgaaattcgaaccgg

SEQ ID NO: 367053 - DNA, 599 bp, Homo sapiens
  misc_feature: GZ8MTXP02H1YS7.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctgggtggagactgggaggagccttgatccagccgtgggggtccctgagactctcctgtgcagcctctgggtcaccgtcagtagcaagtacatgagctgggtccgccgaggctccgaggggaaggggctggagtggatctctagtttattatcgtcggtagtaacacatactacgcagactcggtggacgggccgattccacccatcctacagagaacaattaccaaagaacacggtatatactacaaatcgaactagcctaggagacgccgatacgacgacggaccgtgtaacttacgtgttaggtagtaaaggtaacttaacgtaaaaacgtttacccgaaaacgggtcccggtaccgggggttaaccaaccccgtaaaagtttccgaacgtttaccggtaccggggg

SEQ ID NO: 367054 - DNA, 537 bp, Homo sapiens
  misc_feature: GZ8MTXP02FWRRK.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgcaggctccgaggggaaggggctgggagtggatctctagttatttatcgtcggtagtaacacatactacgcagctcgtggacggccatcacatctccagagacaattaccaagaacacggtgtatcttacaaatagaacagcctagagacgccgatcgacgacggccgtagtattactgtgtgagatacaaaacttccgaaacgccggacgggggtaccacccgaagttcgacgtacgtaccggggg

SEQ ID NO: 367055 - DNA, 535 bp, Homo sapiens
  misc_feature: GZ8MTXP02HA35O.22.11.A11.1.454.CMB.2.raw
  modified_base (251)..(251): a, c, t, g, unknown or other
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctntgggttcaccgtcagtagcaagtcatgagctggtccgccaggctccgaggggaaggggctgggagtggatcgtcagttattatctcggtgtaacacatactacgcagactccggtggacgggccgattcaccatctaccagagacaattaccaagaacacggtagtactcttacaaatagaacagcctgagagccgatcgacacggccgtgtacttactgtgtgagatacaaaacttccgaaagcccggacggggtacacccaaagttcgacgtacgtacgggg

SEQ ID NO: 367056 - DNA, 565 bp, Homo sapiens
  misc_feature: GZ8MTXP02HHE5S.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctggtccgccaggcctccgaggggaaggggctgggagtgggatcgtcagtttatttatcgtccggtaggtaacacattactacgcagactccggtgggacgggcccgattccaccatctcccagagacaattaccaagaacacggtagtatcttacaaatagaacagcctggagagccgatcgacacggccgtgtacttacgtgtgtgagtatacaaaacttccgaaacggtccggacgggggttaccaacccgtaaaagttcgtaacgtacggtaccgggg

SEQ ID NO: 367057 - DNA, 521 bp, Homo sapiens
  misc_feature: GZ8MTXP02I1B9Q.22.11.A11.1.454.CMB.2.raw
  modified_base (349)..(349): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgaggggaaggggctggagtgggatctcagttattatctcggtgtaacncatactacgcagactcgtggaggccgattcaccatctccagagacaattccaagaacacggtgtatcttacaaatgaacagcctgagagccgatgacacggccgtgtattactgtgtgagatacaaaacttccaaagccggcggggtacacccaaatcgactacgtacgggg

SEQ ID NO: 367058 - DNA, 574 bp, Homo sapiens
  misc_feature: GZ8MTXP02JCFRJ.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtgggggtccctgagactctcctgtgcagcctctgggttcaccgtcagtagcaagtacatgagcgtgggtccgccaggcctaccgaggggaaggggctgggagtggatctcgagtttattactcgtcggtagtaacacattacctcgcagtaccgtccgtgggacgggccattccacctatctaccagagaactaactaccaaagaacacggtagtaatacttacaaatagaaacacgaccagagacgccgatcgaacgacggtccgttagtattacgtggtagtagacgtataacaaaacgttaaccgaacggacccggacggggtaccaacccgtaaagttacgaaaccg

SEQ ID NO: 367059 - DNA, 564 bp, Homo sapiens
  misc_feature: GZ8MTXP02HWTVH.22.11.A11.1.454.CMB.2.raw
  modified_base (291)..(291): a, c, t, g, unknown or other
  modified_base (348)..(348): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccnccaggctccgaggggaagggctgggagtggatctcagtttattatctcggtgtaacncatactacgcagactcgtggacgggccattcaccatctcagagacaattacccaaagaacacggtgtatcttacaaattgaacagacctagagagaccgatgacacggccgtagtacttacgtgtgtacgaggtactaactaaaacgttaccgaaacggtaacccggacgggggtacccaacccgtaaaatttacggaacgtttacggaccggggg

SEQ ID NO: 367060 - DNA, 581 bp, Homo sapiens
  misc_feature: GZ8MTXP02JXVWP.22.11.A11.1.454.CMB.2.raw
  modified_base (248)..(248): a, c, t, g, unknown or other
  modified_base (277)..(277): a, c, t, g, unknown or other
  modified_base (312)..(312): a, c, t, g, unknown or other
tcagacatacgcgtcacgaccggtgctcgatttagctacgactgcagggctgggagaggagcccagcactgggattccgaggtgtttccattcggtgatcagcactgaacacagaggactcaccatggagttttggctgagcgtggtttcgtgtaggctattacaaaaggtgtccagtgtgaggtgcagctggtggagactggaggagccttgatccagccgtgggggtcctgagactctcctgtgcncgctcgtcggtcacgtcgagagacagtanatgagcgtcggcgcgcgcgtcgaggagggcgtggnggtgagtcgtacgtagttattacgtcgtcgtacgtactactactacgtcgacgacgtacgtcgtcggacggtacgtactacactactctacgacgacgactactacaacgaacgtacgtacgtactactactaatagaacgacgacgtacgacgacgacgacgtacgacgacgtacgtacgttacgttacgtcgtagtacgtacgtacgtaacgtaaacgtaaccgaacggtaccggtaccggtaccgtaaccgtaacgtaacgtaacg

SEQ ID NO: 367061 - DNA, 530 bp, Homo sapiens
  misc_feature: GZ8MTXP02I5TO1.22.11.A11.1.454.CMB.2.raw
  modified_base (292)..(292): a, c, t, g, unknown or other
  modified_base (450)..(450): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccnccaggctccgaggggaacggggctggagtggatctcagttattatctcggtgtacacatactacgcagactccggtggacggccgattcaccatctccagagacaattacaagaacacggtgtatcttacgaaatgaacagcctgagagccgatgacncggccgtgtattacgtgtgtgagactacaaaacttccgaagccggcgggggtacaccgtaagtacgacgtacgtacgggg

SEQ ID NO: 367062 - DNA, 535 bp, Homo sapiens
  misc_feature: GZ8MTXP02JFT2Z.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggccgccaggctccgaggggaaggggctagggagtggatctcagtttatttactctcgggtagtaacacatactcgcagactccgtggaggcgattcacatcacagagacaactacaagaacacgtgtactcttacaaatgaacagacctagagacgaccgatcgacacggcgtgtattacgtgtgtagagactacaaaacttccgaaacggcccggacggggtaccaaccgtaactacgtaaccg

SEQ ID NO: 367063 - DNA, 527 bp, Homo sapiens
  misc_feature: GZ8MTXP02GJOSZ.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgaggggaagggctggagtgggatctcagttattatctcggtgtaacacatactacgcagactcggtggaggccgattcaccatctccagagacaattaccaagaacacggtgtatctacaaatgaacagcctagagagccgatgacgacgccgtgtatactgtgtgagatacaaaacttccgaacgccggacgggggtacacccgtaagtacgactacgtacgggg

SEQ ID NO: 367064 - DNA, 531 bp, Homo sapiens
  misc_feature: GZ8MTXP02FZ73F.22.11.A11.1.454.CMB.2.raw
  modified_base (360)..(360): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgagggaaggggctggagtggatctcagttatttatcgtcggtgtaacacatactacgcngactcgtggagccgattcacatctccagacgacaataccaagaacacggtgtatcttacaaatgaacagcctagagacgcgatgacgacgccgtgtattactgtgtagagactacaaaacttccgaaagccggtacggggtacaacccgtaagtacgacgtacgtacgggg

SEQ ID NO: 367065 - DNA, 579 bp, Homo sapiens
  misc_feature: GZ8MTXP02IBKQM.22.11.A11.1.454.CMB.2.raw
  modified_base (290)..(290): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtgggggtccctgagactctcctgtgcagcctctgggtcaccgtcagtagcaagtacatgagctgggtccnccaggctccgaggggaaggggctgggagtgggatcgtcaagtttatttagtcgtccggtaggtaaaccacaattacgtacgcagaccgtcgtgggaggccgtatcaccatcaccagagacaattaccaagacacggagtatactactaaatgaactagcctagagagccgaatcggacacggccgtagtattacgtggtgtacgagtactaactaaaacttaccgaaacggcccggtaccgggggtacaaaaccccgtaaagtttacggaccgttaacggacccggggg

SEQ ID NO: 367066 - DNA, 596 bp, Homo sapiens
  misc_feature: GZ8MTXP02I3H2C.22.11.A11.1.454.CMB.2.raw
  modified_base (361)..(361): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagcgtgggtccgccaggctccgaggggaagggctggagtggatctctagttattatctcggtagtaacacatactacgcngactcgtggaggccgatcaccatctccgagagacaatccaaagaacacggtgtactacttacaaatgaaacagacctagaagacgcgagtacgaacgaccggaccgttagttaacttaaccgtggttagtacggaaggtaactaacgtaaaaacgtttcccgaaaacggtccccgggtacgggggttacccaaaaccccgtaaaagttccggtaaacgtaccggtaacccggggg

SEQ ID NO: 367067 - DNA, 539 bp, Homo sapiens
  misc_feature: GZ8MTXP02F9ZTH.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagctggtccgcaggctccgaaggggaggggctggagtggatctcagttattatctcggtgtaacacatactacgcagactcgtggacggccgattcaccatctccagagacaattaccaagaacacggtgtactcttacaaatgaaacagcctagagacgccgatgacacggccgtagtatacgtgtgtgaagtactacaaaacttccgaaacgccggtacggggtacaacccgtaattacgacctacgtaccgggg

SEQ ID NO: 367068 - DNA, 550 bp, Homo sapiens
  misc_feature: GZ8MTXP02F4ZOO.22.11.A11.1.454.CMB.2.raw
  modified_base (331)..(331): a, c, t, g, unknown or other
  modified_base (373)..(373): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagcgtgggtccgccaggctccgaggggaaggggctggagtggatctnagtttattatctcggtagtaacacatactacgcagactccgnggacggcgattcaccatctaccagagacaattaccaaagaacacgtagtatactacaaatgaacagcctagagagccgatcgacacggccgtagtattaactgtagtagagtaactacaaaattccgaaacgtacccgggacgggggttaccaaacccgtaaagtttacgaaaccgg

SEQ ID NO: 367069 - DNA, 527 bp, Homo sapiens
  misc_feature: GZ8MTXP02I30ZG.22.11.A11.1.454.CMB.2.raw
  modified_base (444)..(444): a, c, t, g, unknown or other
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctggtccgccaggctccgaggggaaggggctgggagtggatctcagttattatctcggtgtaacacatactacgcagactcggtggaggccagttcaccatctccagagacaatcaagacacgtagtatcttacaaatgaacagcctagagagccgatgaacncggaccgtgtattactgtgtgagactacaaaacttccaaagccgacgggggtaccaacccgtaaatcgaactacgtaccgggg

SEQ ID NO: 367070 - DNA, 551 bp, Homo sapiens
  misc_feature: GZ8MTXP02H0TPT.22.11.A11.1.454.CMB.2.raw
  modified_base (359)..(359): a, c, t, g, unknown or other
  modified_base (370)..(370): a, c, t, g, unknown or other
  modified_base (428)..(428): a, c, t, g, unknown or other
  modified_base (486)..(486): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagactgggaggagccttgatccagccgtggggggtccctgagactctcctgtgcagcctcgtgggttcaccgtcagtagcaagtacatgagctgggtccgccagggctccgaggggaaggggctgggagtggatctcagtttattatcgtccggtgtaaccncatactacgcngactcggtggacgggccattcaccatctaccagacgacaattaccaaagaacacggtntactctaacaaatagaacagacctagagacgccgatagacgacggccgtagtattacngtgtagagatactaaactccgaaagccggacggggtacacccgtaatacgacgtacggtccgggg

SEQ ID NO: 367071 - DNA, 539 bp, Homo sapiens
  misc_feature: GZ8MTXP02JQYGM.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagcgtgggtccgccaggctccgaggggaagggctgggagtggatctcagtttattactcgtcggtagtaacacatactacgcagtacgtccgtgggacgggccagtcaccatctcagagacatacaagacacgtgtatcttacaatagaacagcctagagacgccgatcgacgacgccgtagtactacgtgtgtacgagactacaaaacttccgaacggtccggtacggggtaccaacccgtaaagtcgtaaccg

SEQ ID NO: 367072 - DNA, 540 bp, Homo sapiens
  misc_feature: GZ8MTXP02GNQ3Z.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtggggggtccctgagactctcctgtgcagcctctgggttcaccgtcagtagcaagtacatgagctgggtccgccaggctccgaggggaaggggctgggagtggatctcagtttatttatcgtcggtggtaacacatactcgcagactccgtggagggccatcaccatctccagagacattaccaagaacacgtgtatctacaaatgaacacgacctgagagaccgatgacgacggccgtagtacttacgtgtagtgagactactaaaacgttccgaacggaccggacgggggtaccaacccgtaagttacgtaaccg

SEQ ID NO: 367073 - DNA, 533 bp, Homo sapiens
  misc_feature: GZ8MTXP02HLJ1L.22.11.A11.1.454.CMB.2.raw
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgccaggctccgaggggaaggggctggagtgggatctcagtttattatctcggtggtaacacatactacgcagactccgtggagggccgattcaccatctccagagacaatccaagaacacggtgtatcttacaaatgaaactagacctgagagaccgatcgacacggccgtagtattactgtgtagagatacaaaattccgaaagccggacgggggtcacccgaaattcgaactacgtacgggg

SEQ ID NO: 367074 - DNA, 525 bp, Homo sapiens
  misc_feature: GZ8MTXP02H52Z2.22.11.A11.1.454.CMB.2.raw
  modified_base (294)..(294): a, c, t, g, unknown or other
  modified_base (364)..(364): a, c, t, g, unknown or other
  modified_base (417)..(417): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagactgggaggagccttgatccagccgtgggggtccctgagactctcctgtgcagcctctgggttcaccgtcagtagcaagtacatgagctgggtccnccaggctccgaggggaaggggctgggagtgggatctcagtttattatctcggtgtaacacatactacgcngactcgtggaggccgatcaccatctccagagacaattaccaaagaacacggtntatcttacaaatgaacagcctgagagccgatgacacgcgtagtattactgtgtgagatacaaaacttcaagccggacggggtacaccgaaattcgacttacgacgggg

SEQ ID NO: 367075 - DNA, 620 bp, Homo sapiens
  misc_feature: GZ8MTXP02JNI2C.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgtgggttcaccgtcagtagcaagtacatgagcgtcggtccgccaggccctcggaggggaaggggctgggagtggatctacgtagtttatttactcgtccggtagtaaccacactactacgcacgtaccgtcggtcgggacggccgtattccaccctagtcctaccgagacgaactaacttaccgaaacgtaacgtacgggttatacttacttaaacaaagtacgaaacagtccgtagacgacgtccgaagtcgaaccgacgggtccgtagttacgttacgtgtggtacgaagtactaacgtaaaacttccgaacggccgggtacggggtaccaaacccgtaagtacggaaccgtacggtaccgggg

SEQ ID NO: 367076 - DNA, 542 bp, Homo sapiens
  misc_feature: GZ8MTXP02JVANX.22.11.A11.1.454.CMB.2.raw
  modified_base (482)..(482): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagctgggtccgccaggctccgaggggaaggggctgggagtggatctcagtttatttatcgtcggtaggtaacactatactcgcagacctccgtgggacggccgattcaccatcctaccagagacaataccaagaacacgtgtatcttacaaatgaactagcctagagacgccgatgacgacggccgttagtattacngtgagagactacaaaagtccgaaacgccggacggggtaccaacccgtaaagtcgtaaccg

SEQ ID NO: 367077 - DNA, 668 bp, Homo sapiens
  misc_feature: GZ8MTXP02HDEUN.22.11.A11.1.454.CMB.2.raw
  modified_base (255)..(255): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagctggtggagacgtggaggagccttgactccaggccggtgggggtccctgacgactctctgtgcngcctcgtggtccaccgtcagtagcaagtacatgagcgtcgggtcccgccgagggcctccggaaaggggaacggggcgtagggaggtgggacttcgtctaagtttacttacgtcgttaccgggtagtaaaccactaactacgtacgacacgtaccgtccgggtggacggggtccctacttccaaccctactcctaccgaagacgaactaaacttaccgaaacgaacgaacggtatactacttaacaaaatagaaactagacctaggaacgacgaccgaagacgacggaaccggtccgtacgttaacttacgtgtgtagacgtaaactaaaccgtaaaacttacccgaaacgggccggtaccgggggtaaccaaacccgtaaaacgttacgaaaccgttaacggtaacccggggg

SEQ ID NO: 367078 - DNA, 742 bp, Homo sapiens
  misc_feature: GZ8MTXP02HD8Z7.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtggtcaccgtcagtagcaagtacagtgacgcgtgggtccgccgaggcctccggaggggaagggctgggagtggactcgtcgtagtttattacgtcgtcggtacgtaacactaattaccgtacgctaacggtaccgtccgggtaggggacggggaccgtaactttcccaacctacgttacctacccgtaaaggaacgtaaacctaaacgtttacccgaaaaggtaaaccgtaccggggttaattaaacttacccgtttaacaaaacgttacgaaaccgtacggtacccgttaaggaacgggtaaccggaccggtaaacgttacggaaaccggtaccgggtacccggtttaaggttaaacttaccggttacgggtagtaacggaaagttaaccgtaaaccgttaaaaacgttccccggaaacgggtaccccgggggttaccgggggtaaaccctaaacccggttaaaacgtttacggtaaaccccgg

SEQ ID NO: 367079 - DNA, 531 bp, Homo sapiens
  misc_feature: GZ8MTXP02F6IZN.22.11.A11.1.454.CMB.2.raw
  modified_base (349)..(349): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgcaggctccgaggggaaggggctgggagtggatctcagttattatcgtcggtgtaacanatactacgcagactccggtggacgggccgattccacactctccagagactaattaccaagaacacggtgtatcttacaaatgaacagcctagagacgcgatgacgcggccgtgtacttacgtgtgtgagatacaaacttcaagccggacggggtaccaaccgtaatacgacgtacgtcgggg

SEQ ID NO: 367080 - DNA, 550 bp, Homo sapiens
  misc_feature: GZ8MTXP02IYDEM.22.11.A11.1.454.CMB.2.raw
  modified_base (293)..(293): a, c, t, g, unknown or other
  modified_base (368)..(368): a, c, t, g, unknown or other
  modified_base (429)..(429): a, c, t, g, unknown or other
tcagacatacgcgtcacgaccggtgctcgatttagctacgactgcagggggggagaggagcccagcactgggattcctaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccnccagggctccgaggggaaggggctggagtgggatctctagtttatttatcgtccggtagtaacacatactacgcngactccgtggagggccattcaccatctccagagacaattacaacgaacacgtgtatcttanaaactagaacagcctgaagacgaccgatagaacgacggccgtagttattacgtgtgtgagaatacaaaaacttccaaagccggcgggggtaccaacccgtaaattcgacgtacgtacgggg

SEQ ID NO: 367081 - DNA, 552 bp, Homo sapiens
  misc_feature: GZ8MTXP02JSAXL.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgccaggctccgaggggaaggggctggaatgggatctcagtttattatctccggtggtaacacatactacgcagactccggtggagggccattccaccatctccagagacattaccaagaacacggtgtatcttacaaatagaacagcctagagagccgatgacgacggccgtagtacttactgtgtgagaactactaaaacgttccgaacggcccggacgggggtaccaaccccgtaaagttacgaccgtaacgtccggggg

SEQ ID NO: 367082 - DNA, 555 bp, Homo sapiens
  misc_feature: GZ8MTXP02FLKGH.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagctgggtccgccaggctccgaggggaggggctgggagtggatctctagtttattactcgtcggtaggtaacacagtactacgcagactccgtggacgggccattcaccatctaccagacgacaacttacaaagaacacggtgtatcttacaaatgaacacgcctagagacgaccgatgaacacggccgtagtacttagtgtgtagacgtaatacaaaacgttccgaaacggaccggacgggggtaccaaaccctaaagtcgtaaaccgg

SEQ ID NO: 367083 - DNA, 601 bp, Homo sapiens
  misc_feature: GZ8MTXP02GPUMM.22.11.A11.1.454.CMB.2.raw
  modified_base (291)..(291): a, c, t, g, unknown or other
  modified_base (335)..(335): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctggttcaccgtcagtagcaagtacatgagctgggtccnccaggctccgaggggaagggctgggagtggatctctagttattntctcggtagtaacacatactacgcagactcggtggacgggccgattccacctactctaccgagacgaacaattaccaaagaacgtacggtgtaactcttaacaaagtacgaactagcctagacgagaccgatcggacgaccgggaccgtaggtaacttacgtggttagtacggaacgtataaccgaaaaacttcccggaaaagcccggggtaccgggggttaaccaaacccgtaaagtttacggaaaccgtacggtaacccggggg

SEQ ID NO: 367084 - DNA, 669 bp, Homo sapiens
  misc_feature: GZ8MTXP02HOCQN.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtcgggtccgccgaggcgtaccgaggggaggggctgggagtgggatctacgtagtttattagtcgtccggtagtaacactactactacgcagaccgtcggtagggacggccgtattaccacctagtcctaccgagaacgactaaacgttaccgaaagaaccgtacggtatacttacttaaacaaattacgaaaccgtgacccgtaggaacgacgacccgtaagacggaaccggtaccggtaccgtagttaacgttaacgtggttaggtaggtaaacggtaacttaaacgtaaaaaccgtttccggaaaaccgggtcccggggtaaccgggggttaacccaaacccggtaaaagtttcggaaacccgtttacggtaacccggggg

SEQ ID NO: 367085 - DNA, 713 bp, Homo sapiens
  misc_feature: GZ8MTXP02HXSM0.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtggttccaccgtcagtagcaagtacatgagcgtgggtccgccgaggcctaccgaggggaaggggctgggagtggatctctagtttattactcgtcggtggtaacactataactcgacagacctcccgggtaggacggggacctacgttacccaccgtactcccgtaccgaaggaacgaaacctaaactttaaccccgaaaaggtaaacccgtacggggttacgttaaactttaccttaaaccgtaaaagtttaacggaaaaccgtaacggtcccgttaagggaaacggaaccggaaccccgtagttaacggaacccgtaaccggggtaccccgttaggttaacgtttaaccgtggttacggtagtaacggtaactaaaccgtaaaaacgttaacccgaaacgggcccgggtaccgggggtaacccaaacccgtaaaacgtttaccggaaacccggg

SEQ ID NO: 367086 - DNA, 562 bp, Homo sapiens
  misc_feature: GZ8MTXP02JWQH8.22.11.A11.1.454.CMB.2.raw
  modified_base (364)..(364): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagctgggtccgccaggctccgaggggaggggctgggagtggatctctagtttattatcgtcggtggtaacacatactacgcngacgtcggtgggacgggccattcaccatcctcagacgacaattaccaagaacacggtgtactacttacaaatagaacagcctagagacgccgatcgacgacggccgtagtattacgtgtgtagagactaacaaaacttaccgaacggccggtaccgggggtaccaacccgtaaagttcgtaaccgtacggtaccgggg

SEQ ID NO: 367087 - DNA, 557 bp, Homo sapiens
  misc_feature: GZ8MTXP02JKWTM.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctcgtgggtcaccgtcagtagcaagtacatgagctgggtccgccaggcctccgaggggaaggggctgggagtgggatcgtctagtttatttatcgtcggtgtaacacatactacgcagctccggtgggacgggccgattccaccactctaccagagacaattaccaaagaacacggtagtatcttacaaatgaaacacgacctagagacgaccgatagacacgggaccgtgtattacgtgtgtgaggatactaaaacttccgaagccggcgggggtaccacccgtaatacgacgtacgtaccgggg

SEQ ID NO: 367088 - DNA, 649 bp, Homo sapiens
  misc_feature: GZ8MTXP02I2DIZ.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtgggggtccctgagactctcctgtgcacgcctcgtgggtccaccgtcagtagcaagtacatggagcgtgggtcccgccaggcctccggaggggaaggggcgtgggagtgggatcgttactagtttattatcgtccgggtagtaaccactactacgtaccgacacgtacctccgggtgggacggccgtacgttcacctatcctaccagaacgaactaacttaccgaaagaacgtacggtatactcttaacaaatacgaacagacctggaacgacgccgagtcggacgtaccgggccgttagttaactttacgtggttagttacggagtaacttaaccgtaaaaacgttcccggaaacgggtcccggggtaccgggggtaacctaaacccgtaaaagttccggaaaccgtttacgggtaacccggggg

SEQ ID NO: 367089 - DNA, 552 bp, Homo sapiens
  misc_feature: GZ8MTXP02JT09A.22.11.A11.1.454.CMB.2.raw
  modified_base (391)..(391): a, c, t, g, unknown or other
  modified_base (397)..(397): a, c, t, g, unknown or other
  modified_base (411)..(411): a, c, t, g, unknown or other
  modified_base (434)..(434): a, c, t, g, unknown or other
  modified_base (480)..(480): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcgtggtttcctgttgctattcaaaaggtgtccagtgtgaggtgcagctggtggagactggaggagccttgatccagccgtgggggtccctgagactctcctgtgcagcctctgggttcaccgtcagtagcagtacatgagcgtggtccgccgaggctccgagggaaggggctgggagtggatctcagtttattactcgtcggtaggtaacacgattactcgcagtactccgtggacggcgatcacatcnccaganacaatcaagtaacncggtatatcttacaaagtcgaanacgacctgagacgaccgatacgacgacggccgttaggtacttacgngtgtaggtaactaacgtaacgtaaacgtaaccgaacggtaccggtacggtaccaaccgtaacgtacgtaacg

SEQ ID NO: 367090 - DNA, 523 bp, Homo sapiens
  misc_feature: GZ8MTXP02HM2UP.22.11.A11.1.454.CMB.2.raw
  modified_base (290)..(290): a, c, t, g, unknown or other
  modified_base (348)..(348): a, c, t, g, unknown or other
tcagacatacgcgtcacgaccggtgctcgatttagctacgactgcagggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccnccaggctccgaggggaaggggctggagtggatctcagttattatctccggtggtaacncatactacgcagactcgtggaggccgattcaccatctccagagacaattccaaagaacacggtgtatacttacaaatagaacagcctagaagagaccgatgacacggaccgtgtattactgtgtgagatcaaaacttcaaagccgcggggtacacccaaattcgacttacgcggg

SEQ ID NO: 367091 - DNA, 582 bp, Homo sapiens
  misc_feature: GZ8MTXP02GHQYM.22.11.A11.1.454.CMB.2.raw
  modified_base (296)..(296): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctcgtgggttcaccgtcagtagcaagtacatgagcgtgggtccnccaggcctccgaggggaaggggctgggagtgggatcgtctagtttattatcgtcggtagtaacacatactacgcagactcggtgggacggccgtattccaccatctaccagagacaattaccaaagaacacggtagtactacttaacaaatacgaacacgcctaggagacgccgatcgaacgacggtaccgtagtacttacgtggtgtagagtaactaacaaaacttccgaaacggccggacgggggtaccaaacccgtaagtaccgaacgtacggtaaccggggg

SEQ ID NO: 367092 - DNA, 536 bp, Homo sapiens
  misc_feature: GZ8MTXP02GPFKF.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccgcaggctccgaggggaaggggctgggagtgggatctcagttatttatctcggtgtaacactatactacgcagactccggtagggaggccgattccaccactctaccagagacaattaccaagaacacggtagtactacttacaaatgaacagcctagagacgccgatgacacggccgtagtattacgtgtgtagagatacaaaacttccaagccgcggggtacaccaatacgactacgtacgggg

SEQ ID NO: 367093 - DNA, 578 bp, Homo sapiens
  misc_feature: GZ8MTXP02FFWXH.22.11.A11.1.454.CMB.2.raw
  modified_base (331)..(331): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagcgtgggtccgccaggctccgaggggaggggctgggagtggatcntagtttattacgtcgtcggtaggtaacacatactcgcacgacgtccgtggacggggccattcaccatcctacagagacaatacaaagacaggtatatctacaaatgaacacgctagacgacgaccgagtacgaacgacggtccgtaggtacttacgtggtagttagaacgtactaacaaaacgttaacccgaaacgggtacccgggtaccgggggttaccaaaccccgtaaaagtttcggaaaccgg

SEQ ID NO: 367094 - DNA, 746 bp, Homo sapiens
  misc_feature: GZ8MTXP02HJ4DD.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgaggccggtcgggggtccctggacgacctctccgtgtcgcagcctcgtgggttccaccgtcagtagcaagtacagtgacgcgtcgggtccgccgaggtccgtccggaggggaacggggtctgggagtgggtaactctcgtaagtttatttacgtaccgtcggttacggtaaactacgtaacttaaccgttacgaccgtaacggacccgttccgggtacgggggacgggtaccgtacgttaccaccgtaactccgtaccgaagacgtaaactaccttaaccgaaacgaacgtacgggttacgttaacgtaccgtttaacaaaacttaacggaaactacggtacccgtaaggaaccggaacggtacccgaaagttaccggaaaccgtaccggggtacccgttagggttaacctttaaggttcggtaggtaacgtaaggtaacttaaaaccgtaaaacgttaaccggaaccggtacccgggtaccgggggtaacccaaacccgtaaaacggtttacgtaaaacccgggg

SEQ ID NO: 367095 - DNA, 666 bp, Homo sapiens
  misc_feature: GZ8MTXP02HKZD8.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgtggtcaccgtcagtagcaagtacatgagcgtggtccgccgaggctaccggaggggaacgggcgtgggagtgggatcgtactagtttattacgtcgtcggtagtaacacgtaatactacgcagtaccgtcggtaggacgggccgtaattccgaaccatcctaccagacgaactaactaccaaagaacgtacggtagtaactacgttaaacaaaacgttacgaaaccgtacgtaccctaaggaaacggaccgacccggaattacgggaaaccgacccgggttaccggtagttaacgtttaccgtagttaggtacgaaagtaactaacgtaaaaacgttccgaacggtaacccggggtaccggggtaaccaaacccggtaaactttacggaaccgtttacggtaacccggggg

SEQ ID NO: 367096 - DNA, 563 bp, Homo sapiens
  misc_feature: GZ8MTXP02GJE9X.22.11.A11.1.454.CMB.2.raw
  modified_base (295)..(295): a, c, t, g, unknown or other
  modified_base (466)..(466): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccnccaggctccgaggggagggctgggagtggatctcagtttattacgtcgtcggtagtaacacatactacgcagacctccgtaggacgggccattccacctatcctacagagaacaacttccaaagtaacacgtgtaactacttacaatagaactacgctacgagaacgcganagacgaacggccgtacgtattacgtgtggtacgagtataacctaaaataaccgtaacggacccggacggggtacgaaacccgtaatacggtaacccg

SEQ ID NO: 367097 - DNA, 621 bp, Homo sapiens
  misc_feature: GZ8MTXP02JS7DC.22.11.A11.1.454.CMB.2.raw
  modified_base (422)..(422): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagctgggtccgcaggctccgaggggagggctggagtgggatctcagttattagtctcggtgtaacatactactacgcagacctcggaggacggggccattccgacactcctaccagagacaacttaccaagaacacggtntagtctaacaaatagaacagacccgtagaagacgaccgagtacgaacgacggtaccgtagttaacttaccgtaggttggtaggaacgtaacgttaaaccaaaaacgtttcccgaaaacgggtcccgggggtaacccggggggtaaccctaaaccccggttaaaacgtttacggaacccggttaacggtaacccgggggg

SEQ ID NO: 367098 - DNA, 721 bp, Homo sapiens
  misc_feature: GZ8MTXP02HDYNI.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgatccagccgtgggggtccctgagactctcctgtgcagcctcgtgggtccaccgtcagtagcaagtacagtgaggtcgtcggggtcccgccgacgggtccgtaccggaagggggaacggggcgtaggggaggtgggtactcgttacgtaagttttatttacgtcgttaccgggttacggtaaacctactaacttacgtaaccggacacggtaccgttccgggtacggggaaccggggtcccggttaactttacccgaaacccgtacttcccttaacccgaaagtaacggaaactaaacgttaaccgaaacggtaaacgtaccggttaagttactacgttaaacaaaacgttagaactacgaccgtagaacgtacgaccgagtacgaacgtacggtaccgtagttaacgttacgtggtagtacgaagtaacgtaactaaaacgtccgaacggtccggtaccgggtaactaaacccgtaaacgtacggtaccgtacgggtaacccgggg

SEQ ID NO: 367099 - DNA, 557 bp, Homo sapiens
  misc_feature: GZ8MTXP02J5O14.22.11.A11.1.454.CMB.2.raw
  modified_base (285)..(285): a, c, t, g, unknown or other
  modified_base (352)..(352): a, c, t, g, unknown or other
  modified_base (364)..(364): a, c, t, g, unknown or other
  modified_base (372)..(372): a, c, t, g, unknown or other
  modified_base (399)..(399): a, c, t, g, unknown or other
  modified_base (465)..(465): a, c, t, g, unknown or other
  modified_base (488)..(488): a, c, t, g, unknown or other
tcagacatacgcgtcacgaccggtgctcgatttagctacgactgcgaggggggagaggagcccagcactgggattccgaggtgttcccattcggtgatcagcactgaacacagaggactcaccatggagttttggctgagtcttgggttttccttgttgcttatttcaaaaggtgtccagtgtgaggtgcagcgtggtggagacgtggaggagccttggactccgaggtccgtggggggtccctgagacctctcctgtgcagcctcgtgggttcaccgtcagtanacaagtcatgagcgtgggccgccgagggctccgaggggaagggctggagtggatctcagtttattancgtcggagtacnatcacgcngactccggtggacggccatcaccatcncagacgacaattaccgaaagactacggtattactacttacaaatggacacgtccagagacgtcganacgacgcgtccgtagtacttagngtgtacgatacacaaactccgaacggccggacggggaccaccgtaaacgtcgtaacgtcgtaccggggg

SEQ ID NO: 367100 - DNA, 554 bp, Homo sapiens
  misc_feature: GZ8MTXP02JOC1H.22.11.A11.1.454.CMB.2.raw
  modified_base (361)..(361): a, c, t, g, unknown or other
  modified_base (462)..(462): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgaggggaaggggctggagtggatctcagttatttatctcggtgtaacactatactacgcngacctccggtggtacgggccgtattcaccatctacccagacgacaacttaccaagaacacggtagtactcttacaaatagaacagcctagagacgccgaancgacgacggccgtagtattactgtgtgagatacaaaacgttaccaacgccggacgggggtaccacccgtaaatacgtacctacggtacgggg

SEQ ID NO: 367101 - DNA, 602 bp, Homo sapiens
  misc_feature: GZ8MTXP02J0P0G.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagcgtgggtccgccgaggcctccgaggggaaggggctgggaggtgggatctctagtttatttagtcgttcggtaggtaaccactatactacgcagccgtccggtggacgggccgatttccaccatcctaccagagaactaacttaccgaaagaactacgggtagttatactttacaaaatcgaaacagcctaggagacgaccgatacgaacgacggtccgtattacttacgtgtgtagaacgataacgtaaaacttcccgaaacggcccgggaccgggggttacaaccccgtaaagttcggaaccgtacggtaccggggg

SEQ ID NO: 367102 - DNA, 620 bp, Homo sapiens
  misc_feature: GZ8MTXP02FZXSB.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgtggttcaccgtcagtagacaagtacatgagcgtcgggtccgccagggcctccggaaggggaaggggcgtagggaggtgggatcgtactagttatttagtcgtccggtagtaacactatactacgcagacctccggtagggacggccgtattccaacctactctaccgagacgaaactaacttaccgaaacgtaacgacggttataattctaacgaaatacgaacagccgtaggagacggaccgagtacgaaccggacggtaccgttagtaacttacgtaggtaggtacgaagtaactaactaaaacttcgaaaacggccggtacggggtaccaaacccgtaagtacgaaccgtacggtaccgggg

SEQ ID NO: 367103 - DNA, 698 bp, Homo sapiens
  misc_feature: GZ8MTXP02JDSJO.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgactccagccggtgggggtccctgacgactctcctgtcgcagcctcgtgggttcaccgtcagtacgacaagtacagtgacgtcgtcgggtcccgcgacggccgtaccggaggggaacggggtcgtagggaggtggtatcgtacgtagtttatttacgtcgtccggtagtaacacgtactacgtacgacgacgtaccgtccgggtagggaccgggtccgtaactttaccgaaccctacttccgtacccaaaggtaacgtaactaaaacgttaaccgaaaacggtaaccgtacgggtttataacttacctttaaacaaattacgggaaaacctcggtacccgttaaggaacggtaccggaccgtaagttacccgggaaaccgccgggttaccgttagtaacgtttcgtggtagtacgaagtaactaactaaaacgtccgaaacgggccgggtacggactaaacccgtatccggacgttacggaccggg

SEQ ID NO: 367104 - DNA, 638 bp, Homo sapiens
  misc_feature: GZ8MTXP02JK9BS.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtgggggtccctgagactctcctgtgcagcctcgtgggttcaccgtcagtagcaagtacatgagcgtcgggtccgccgaggctaccggaggggaacggggctggagtggatctctagtttattagtcgtacggtagtaacacatactacgcagacgtcggtggggacggccgtattccacactcctaccgagaacgactaaacttaccaaagaaccgtacgggtattaactacctttaaacaaaacttacgaaaaccgtagtacccgtagggaaacgaacggtacccggagtacggaaccgaccgggtacgttacgtaacttacgtgggtgtacggtagtaacgtaactaaaacgttccgaaacggccgggtacgggggtaaccaacccgtaagtacggaacttacgggaacccgggg

SEQ ID NO: 367105 - DNA, 558 bp, Homo sapiens
  misc_feature: GZ8MTXP02FS7CP.22.11.A11.1.454.CMB.2.raw
  modified_base (424)..(424): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccgcaggctaccgaggggaagggctgggagtgggatcgtctagttatttatcgtccggtagtaacacatactacgcagactcggtaggacgggccgattcaccactctccgagagacaataccaagaacacggtntacgtcttacaaatgaacagcctagagagtacgatcgacgacggcgtagtattacgtgtgtacgagtactactaaaactccgaacggccggtacgggggtaccaacccgtaagttacgaccgtacgtaccgggg

SEQ ID NO: 367106 - DNA, 581 bp, Homo sapiens
  misc_feature: GZ8MTXP02HNV44.22.11.A11.1.454.CMB.2.raw
  modified_base (451)..(451): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagctgggtccgccaggctccgaggggaaggggcgtgggagtgggatctctagtttatttatcttccggtggtaaacacaacttactaccgcagactcggtggacgggccgtatcgaccatcctcagacgaacaacttaccaaagaactacggtagtactcttacaaatntaaacagtacctagaagacgaccgtatacgacgacggtccgtagtacttacgtgtagagtagaactacgaaaattacccgaaggtccggaccgggggtacaacccgaagtttcgacgttacgaccggggg

SEQ ID NO: 367107 - DNA, 607 bp, Homo sapiens
  misc_feature: GZ8MTXP02HCM5Y.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgtgggttcaccgtcagtagcaagtacatgagcgtgggtccgccaggcctccgaggggaaggggctgggacgtgggatcgtactagttattacgtcgtccggtagtaacacgatactacgcagacgtcggtaggacggccgattccgaccagtcctacagagacaacttaccaacgaactaacggtagtatacgttacaaatacgaacagcctaggacgacgacgagtacgaacgaccggtccgtagtacgttaacgtgttgtacgaagtaactacgtaaaacttaccgaaacggcccggtacgggggtaaccctaaacccgtaaagtttacggaaccgtacggtaaccggggg

SEQ ID NO: 367108 - DNA, 622 bp, Homo sapiens
  misc_feature: GZ8MTXP02H26L8.22.11.A11.1.454.CMB.2.raw
  modified_base (399)..(399): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatggagcgtgggtcccgccgagggcctccgaaggggaaggggcgtagggagtgggatcgtcgtagtttatttactcgtccggtaggtaaaccacaattacgtacgcagtaccgttccggnggggacgggcccgtattccgaacctactcctaccgagacgaaccaaatttaccgaaaagacgtacgggtatacgttacttaacaaaattcgaaacacgcctaggagacgaccgagtacgaacgtcggaccgtagttacttagtgtagtagaagtactaactaaacgttacgaacggtccgggaccgggtaccaaccggtaaattccgaacggttacgacgggg

SEQ ID NO: 367109 - DNA, 549 bp, Homo sapiens
  misc_feature: GZ8MTXP02HN1EF.22.11.A11.1.454.CMB.2.raw
  modified_base (485)..(485): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctggttcaccgtcagtagcaagtacatgagctgggtccgcaggctccgagggaaggggctgggagtggatctctagttattatcgtcggtggtaacacatactcgcagacctccggtggacgggccagttcaccgatctaccagacgacaattaccaaagaacacggtgtactcttacaaatgaaacagacctagagacgccgagtagacgacggccgtagtacttacgngtgtagagtactacaaaattccgaaacgtcccggacggggtaccaacccgtaaagttcgaaccg

SEQ ID NO: 367110 - DNA, 594 bp, Homo sapiens
  misc_feature: GZ8MTXP02IX72G.22.11.A11.1.454.CMB.2.raw
  modified_base (291)..(291): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctggttcaccgtcagtagcaagtacatgagctgggtccnccaggctccgaggggaaggggctgggagtggatctctagttattatctcggtagtaacacatactacgcagactccgtggacggccgtattcaccatctccagagactaataccaagaacacggtagtatacttacaaatagaaacagacctagaagacgccgaatcgaacgacgggtccgtaggtaactttacgtagttggtacgaagtaactaactaaaacgttaccccgaaaagggtccccgggtacgggggtacctaaaaccccgtaaaagttaccggaacgttaacgtaacccggggg

SEQ ID NO: 367111 - DNA, 736 bp, Homo sapiens
  misc_feature: GZ8MTXP02GTCQB.22.11.A11.1.454.CMB.2.raw
  modified_base (249)..(249): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcngcctcgtgggtcaccgtcagtagcaagtacatgagcgtcgggtccgccgaggccgtaccggaaggggaacggggcgtggggaggtgggactcgttacgtagttttatttacgtcgttaccgggttagtaacctacgtataccgtaccgacacggtaccgttccgggtaggggacggggtccgtactttcccaaccctagtttcccaaccgagtaacgaactaaacgttaacccgaaagtaaaccgtaccgggttagttaacttacctttaaacaaaagttacgaaacctacggtaccgtagggaacgacgacccgtaggtacgaaccgtaccgggtaccgttagttaacttacgtggttaggtacgtaaggtaacttaaaccgtaaaaacgtttcccggaaaacgggtccccggggtaacccgggggttaaccctaaaaccccggttaaagtttaccggaaaccgtttacccggggtaacccggggg

SEQ ID NO: 367112 - DNA, 735 bp, Homo sapiens
  misc_feature: GZ8MTXP02JLDB5.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggtcaccgtcagtagcaagtacatgagctgggtccgccgaggctccgaggggaagggctggagtggatctactagttattagtcgtccgggtaggtaacactacgtactacgctacgaccgttcccggtagggtaacggggccgtaatttaccaacctaacgtcccttacccgaaggtaacgaacctaaacgttaccccgaaaaggtaaaccgtaacggggttacgttaacgttaccgtttaaacaaaacgtttacgaaaacccgttacggaccccgttaaggggaacgtaacggcccggtaaagttaccggaaacccgtaccggggttacccgtaggttaacgttaaccgttgggttacggttaaggaaacggttaactaaaccgtaaaaaccgtttcccggaaaacgggtcccgggtaacgggggttaacccaaaaccccgttaaagtttacggaacccgttacgggtacccggggg

SEQ ID NO: 367113 - DNA, 562 bp, Homo sapiens
  misc_feature: GZ8MTXP02G5898.22.11.A11.1.454.CMB.2.raw
  modified_base (412)..(412): a, c, t, g, unknown or other
  modified_base (457)..(457): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctctgggttcaccgtcagtagcaagtacatgagcgtgggtccgccgaggcctaccggaggggaggggcgtgggagtggatctcgtagtttattactcgtcggtaggtaacactattactacgcacgacgtccgtgggacgggccacttccacactccnccgagacgacactacgaagaacgacgtgtatcttacaaatgaacngacctagagacgcgagcgaccgacgcgttagtacttacgtgtgtacgagtactaacaaagttccgaacggtcccgggacgggtacaacccgtaagttcgtaaccg

SEQ ID NO: 367114 - DNA, 679 bp, Homo sapiens
  misc_feature: GZ8MTXP02H1RPS.22.11.A11.1.454.CMB.2.raw
  modified_base (302)..(302): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagactgggaggagccttgatccagccgtggggggtccctgagactctcctgtgcagccctcgtgggttcaccgtcagtagcaagtacatgagcgtcggggtcccnccgaggcctccggaagggggaacggggcgtagggaggtggattcgtacgtagtttattagtcgttcgggtaggtaaaccacgtaactactacgacaggtaccgttccggtacgggacggggaccgtattccgacccatcctacccgaagaacgaaactaaacttacgaaaacgaacgtacgggtattatacttaaactaaagtacaaaacgtcgtcctaggacgacgaccgaagtcgaacgaccggccggttagtaccgtttagtcggttagtacgaaaggtaacttaacgtaaaaacgtttccgaaacgggtcccgggtacgggggtaaacccaaacccgtaaaagtttccgaaccggtttaaacggtcccggggg

SEQ ID NO: 367115 - DNA, 572 bp, Homo sapiens
  misc_feature: GZ8MTXP02FZRF9.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtgggggtccctgagactctcctgtgcagcctctgggtcaccgtcagtagcaagtacatgagcgtcgggtccgcacggctaccgaggggacgggctagggagtggtatctcgtagttattactcgtggtacgtaacatactactcgcacgacgtccgtaggacggacgaatcactcgtacctacagacacacttacaagacgacgtagtactagtacaatacgacagacctaggagacgaccgagtcgaccgtacgtaccgtgtaacgttcgtagtggtagacgtaacgtaactaaaacgttccgaacggtaccggacggggtaccaacccgtaaagttacgtaacgg

SEQ ID NO: 367116 - DNA, 618 bp, Homo sapiens
  misc_feature: GZ8MTXP02IU8K1.22.11.A11.1.454.CMB.2.raw
  modified_base (394)..(394): a, c, t, g, unknown or other
  modified_base (457)..(457): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccgagccgtgggggtccctgagactctcctgtgcagcctcgtggttcaccgtcagtagcaagtacatgagcgtcgggccgccaggctccgaggggaagggcgtaggagtgatcgtcgtagtttattagtcgtcggtagtacactatactacgcagccgtcgtgggacggccatcacctntcctacagaacgactaacgtaccaaagtaacgtcggtatactcttaaacgaaatacgaaaacncgacctaggaacgaccgtaccgatcggaaccgtacggtaccgtagttaactttacgtggtagtagtaagtacttaaacgtaaaaccgtccgtaaaacggccccggggtaacgggtaacctaaacccgtaaagttcggtaacccggtaacggtacccggggg

SEQ ID NO: 367117 - DNA, 538 bp, Homo sapiens
  misc_feature: GZ8MTXP02I79CZ.22.11.A11.1.454.CMB.2.raw
  modified_base (292)..(292): a, c, t, g, unknown or other
  modified_base (358)..(358): a, c, t, g, unknown or other
  modified_base (465)..(465): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccnccaggctccgagggaagggctggagtgggatctcagttattatctcggtgtacacgatactacgcngactccggtggacggccgattcaccatctccagagacaattaccaagaacacggtgtactcttacaaatgaacagcctgagacgccgatgacacggcctgtattacngtgtgagtactacaaaacttccgaaacgccggacgggggtaccaacccgtaaatcgaacgtacgtaccggggg

SEQ ID NO: 367118 - DNA, 657 bp, Homo sapiens
  misc_feature: GZ8MTXP02H60EG.22.11.A11.1.454.CMB.2.raw
  modified_base (341)..(341): a, c, t, g, unknown or other
  modified_base (411)..(411): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtgggggtccctgagactctcctgtgcagccttcgtgggttccaccgtcagtagcaagtacatgagctcggggtccgccgagggcctccgaggggaaggggctgggagtgggattccgtntagtttatttatcgtccgggtagtaacacatactacgcacgaccttcggcggagggccgattccacatcnccgaagcgtaacaacttaccaaagaacgtacggtagtactacttacaaagtcgaaacctagcccgaggacgaaggcccgaagtcggaaccgaaccggggtcccgttaggttaacctttaactggtttcggagaaacggtacttaaaacctaaaaacgtttccccgaaaacgggccccgggggtaccgggggttaaacccaaaccccgtaaaagttccggaaaccgttttaccgggaacccgggggg

SEQ ID NO: 367119 - DNA, 530 bp, Homo sapiens
  misc_feature: GZ8MTXP02GRH05.22.11.A11.1.454.CMB.2.raw
  modified_base (350)..(350): a, c, t, g, unknown or other
tcagacatacgcgtcacgaccggtgctcgatttagctacgactgcaagggggagaggagcccagcactgggattccgaggtgttcccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgccaggctccgaggggaaggggctgggagtgggatctcagttattatctcggtgtaacanatactacgcagactcggtggaggccgattcaccatctccagagacaattaccaagaacacggtgtatctacaaatagaacagcctagagacgaccgatgacacggccgtagtattacgtgtgtgagatacaaaacttcgaagccgacggggtacacccgtaatacgacgtacgtacgggg

SEQ ID NO: 367120 - DNA, 626 bp, Homo sapiens
  misc_feature: GZ8MTXP02JLRMS.22.11.A11.1.454.CMB.2.raw
  modified_base (365)..(365): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtggtcaccgtcagtagcaagtacatgagcgtcgggtccgcaggcctccgagggaaggggctgggagtggatctctagttattatcgtccggtaggtaacacatactacgcngactcggtgggacggcgtacttcaccctatctaccagacgaactaacttacaaagaactacggtataacttacgttaacaaattacgaaactacgacctaggaacgacgtaccgagtcggaaccgtacgggacccgttagtagtttacgtaggttaggtagtaagtaactaacgtaaaaacgtttcccggaaacggtaacccgggaccgggggttaaccaaaccccgtaaagtttaccggaaccgtacggtaacccggggg

SEQ ID NO: 367121 - DNA, 650 bp, Homo sapiens
  misc_feature: GZ8MTXP02FVSVP.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcacgcctcgtgggttcaccgtcagtagcaagtacatgagcgtggtccgcaggctccggaggggaggggcgtggagtggatcgtctagttattatcgtcggtagtaacatatacacgcacgactcggtggacggcgtattccacctatcctaccagaacgaactaaacttaccgaaagtaaccgtacggttatacttacttaaaccaaagttacgaaaaccgacgtacccgtaaggaacgaaccggaccgaagttcggaaaccgaccgggtaccgttagttaactttacggtaggttaggtacgtaaagtaactaaaccgtaaaaacgttccgaaacggtcccggggtaccggggtaaccaaacccgttaaagttacgtaaaccgttacgggtaacccggggg

SEQ ID NO: 367122 - DNA, 542 bp, Homo sapiens
  misc_feature: GZ8MTXP02JEUI8.22.11.A11.1.454.CMB.2.raw
  modified_base (358)..(358): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtgggggtccctgagactctcctgtgcagcctctgggttcaccgtcagtagcaagtacatgagctgggtccgcaggctccgagggaaggggctgggagtggatctcagttatttatctcggtagtaacacatactacgnagctccggtggacgggccgattcaccatctccagacgacaattaccaagaacacgtgtatctacaaatgaacagcctagagagaccgatcgacacggccgtagtacttacgtgtgtagagatacaaaacttccaaacggccggtacgggggtaccacccgtaaattcgaactacggtaccgggg

SEQ ID NO: 367123 - DNA, 637 bp, Homo sapiens
  misc_feature: GZ8MTXP02JCEXS.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagacgtggaggagccttgatccgagccgtgggggtccctgacgactctcctgtgcagcctcgtggtcaccgtcagtagcaagtacatgagcgtcgggtcccgccgaggcctaccggaggggaaggggcgtgggaggtgggatctcgtagtttattagtctccggtaggtaaacacactactaccgacacgtactccgggtggacgggccgtaatttccacctactcctaccaagacgaacctaaacttaccgaaagtaaccgtacgggttataacttccttaaacaaattacgaaaccgacgtacccgtaggaacgacggacccgtagtacgaacgcggtaccgtagtacgttacgtgtagtacgagtaactactaaaacgttccgaacggaaccggtccggggtaaccaacccgtaagtacggacgtacggtaacccggggg

SEQ ID NO: 367124 - DNA, 584 bp, Homo sapiens
  misc_feature: GZ8MTXP02J0C1V.22.11.A11.1.454.CMB.2.raw
  modified_base (513)..(513): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctcggggtccgccgaggctccgaggggaacggggctgggagtggatctcgagtttatttactcgttcgggtagtaaccacatactacgcaaggacctccggtgggacgggccgattccgaccatcctaccgagacgactaacttaccaaagtaacacggtagtactcgttaacaaatagaaacacgactagagacgacgagtgaccgacggccgtacgtacttacgngtagtacgagactaactaaaacttccgaacggcccggtacgggggtaccaacccgtaacttacggtaaccg

SEQ ID NO: 367125 - DNA, 536 bp, Homo sapiens
  misc_feature: GZ8MTXP02ISTEQ.22.11.A11.1.454.CMB.2.raw
  modified_base (358)..(358): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtggggggtccctgagactctcctgtgcagcctctgggttcaccgtcagtagcaagtacatgagctgggtccgccaggctccgaggggaaggggctggagtggatctcagttattatctcggtgtacacatactacgcngactccgtggaggccgattcacatctccagagacaataccaagaacacggtgtatcttacaaatgaaacagcctagagacgccgatgacgacggccgtgtattacgtgtgtgagactacaaaacttcaaacggccggacgggggtaccaacccgtaattacggactacgtaccggggg

SEQ ID NO: 367126 - DNA, 568 bp, Homo sapiens
  misc_feature: GZ8MTXP02F549H.22.11.A11.1.454.CMB.2.raw
  modified_base (431)..(431): a, c, t, g, unknown or other
  modified_base (438)..(438): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtgggtccgccaggcctccgaggggaaggggctgggagtggatcgtcagtttatttatcgtcggtagtaaccatactactacgacagacctccggtagggacggccgtatcacatctaccagagacaataccaaagaacacggtntatctanaaatagaacagcctagagacgaccgatacgacacgggtcctagtattacgtgtgtagaagtactaactaaaactccgaaacgccgggtacggggacctaacccgaaagttcgaaccgtacggtaccgggg

SEQ ID NO: 367127 - DNA, 640 bp, Homo sapiens
  misc_feature: GZ8MTXP02IO6DT.22.11.A11.1.454.CMB.2.raw
  modified_base (562)..(562): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctattcaaaaggtgtccagtgtgaggtgcagctggtggagacgtggaggagccttgatccagccgtgggggtcctgagactctcctgtgcagcctgtggtcaccgtcagtagcaagtacatgagcgtcgggtccgccgagggcctaccggaaggggaacggggcgtgggacgtgggatcgttcgtaagtttattacgtcgttccggtaggtaaacactaatactacgacacgtacgtccggagggtacgggaccgtattaccaccactcctaccgaagacgactaaacttacccaaagtaacgtacggtagtactacttaaacaaaagttacgaaaacgtacgacccgtaggaacgaccggaccgaagtacgacgaccggtccgttaggtaactttacgtgtagtnaaagtactaacgaaaacttccgaaacggtcccggacggggtaccaaacccgtaagttccgaacgtacggtaaccgggg

SEQ ID NO: 367128 - DNA, 669 bp, Homo sapiens
  misc_feature: GZ8MTXP02FRC6X.22.11.A11.1.454.CMB.2.raw
  modified_base (378)..(378): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagacgtggaggagccttggatccagccgtcggggggtccctgagactctcctgtgcacgtcctcgtgggttcaccgtcagtagcaagtacatgagtcgtggtccgccgaggcctaccggaggggaaggggctgggagtggatctctagttattatcgtcggtagtaacactatactacgcncgaccgtccggtagggacggccgtataccactatcctacccgaagacaactaacttacccgaaaagtaacgtacggttataacttactaaacgtaaatacgaaacacgtaccgtaggaacgacggaccgaagtaccggaaccgacggtcccgttaggttaaaccttacgtggttagggtaccaaaggtaaacttaaaccgtaaaaacgttcccggaaaacgggccccggggttaaccggggaacctaaaccccggtaaaagtttccggaaaaccgtcgggtaacccggggg

SEQ ID NO: 367129 - DNA, 779 bp, Homo sapiens
  misc_feature: GZ8MTXP02HSQ7R.22.11.A11.1.454.CMB.2.raw
  modified_base (265)..(265): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctctgtgcagcctcgtggttcaccgtnagtagcaagtacatgagctgggtccgccgaggcctccggaaggggaacggggctgggagtggatcttacgagtttatttagtcgtccgggtacggtaaactacgtaactacgtaccgcgtacggtaccgttcccggtaggggacggggtaccctagtttacccaaccctaacttacccgtaccccgaaggtaaacggaaccctaaaacgtttaaccccgaaaacggtaaaccgtaaacccgggggtttagttaacgttaacccgttttaaaccaaaagtttacggtaaaacccgaaacgggtaccccgttaagggaaccggtaacggaacccccggtaagttaacgggaacccgtaaaccggggtcccggtttaagttaacgtttaccggttaggttacgggttaacggaaggtaaactaaaccgtaaaacttaacccggaaccggaacccgggtaccgggggtaaccctaaaccccgtaaagttaccggtaaccgtttacggtaacccggggg

SEQ ID NO: 367130 - DNA, 571 bp, Homo sapiens
  misc_feature: GZ8MTXP02JI25Y.22.11.A11.1.454.CMB.2.raw
  modified_base (295)..(295): a, c, t, g, unknown or other
  modified_base (446)..(446): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagcgtgggtccnccgagggctccgaggggaaggggctgggagtgggatctctagtttattatcgtcggtaggtaaccatactactacgcaggactccggtagggacgggccgtattccaccatcctacagacgactaattaccaagaacacggtatatcttanaaatagaacagaccctaggaagacgaccgatggaacccccgaggccgtagtactacgtgtgtagagactacaaaactccgaaggccggcggggtacaacccgtaattcgacgtacggtaccgggg

SEQ ID NO: 367131 - DNA, 574 bp, Homo sapiens
  misc_feature: GZ8MTXP02IEG9L.22.11.A11.1.454.CMB.2.raw
  modified_base (294)..(294): a, c, t, g, unknown or other
  modified_base (353)..(353): a, c, t, g, unknown or other
  modified_base (364)..(364): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtgggggtccctgagactctcctgtgcagcctcgtgggtcaccgtcagtagcaagtacatgagcgtgggccncgaggcctccgaggggagggctgggagtgatctcagtttattatcgtccggtagtaacncatactacgcncgactcggtggacggcctatccacactctcagagactaatacaagaactacgtagtatacttacaaagtacgaacagaccgtgaagcgacgatacgacgacggccgttagtacttacgtgtgtagtaagaactacgtaaaacttaccgaacggtaaccggtaccgggggtaccaaccccgtaaagttaccggtaacttacggaccggggg

SEQ ID NO: 367132 - DNA, 735 bp, Homo sapiens
  misc_feature: GZ8MTXP02JHFXG.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccgagccgtgggggtccctgagactctcctgtgcagcctcgtggtccaccgtcagtagacaagtacagtgacgcgtcggtccgccgaggcctaccggaggggaaggggcgtagggagtggattctacgtaagtttatttacgtcgttacgggtagtaaaccactaagttaactaccgactaaggtacccgttaccgggtagggacggggaccctaacgttaccacctactaccgtacccgaagaacgtaaacctaaacgttaccgaaacgaaaccgtacggtacgttaaacttacctttaaacgaaaacgttacgaaaccgtaacggtaccgtaaggaacggtaacggacccggtaagtaccggaacccgtaccgggtacccggttacggttaacgtttaccgtacggttacggttaggaaacgtaacgttaaacccgtaaaaacgttaacccgaaaccgggtacccggggtacccgggggtaaccctaaacccgttaaaaccggtacgtaaacccggg

SEQ ID NO: 367133 - DNA, 554 bp, Homo sapiens
  misc_feature: GZ8MTXP02JGJI6.22.11.A11.1.454.CMB.2.raw
  modified_base (249)..(249): a, c, t, g, unknown or other
  modified_base (297)..(297): a, c, t, g, unknown or other
  modified_base (334)..(334): a, c, t, g, unknown or other
  modified_base (358)..(358): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtncagcctcgtggttccaccgtcagtagcaagtacatgagcgtgggtccnccaggctccgaggggaaggggctgggagtggatcgtnagtttattactctcggtagtaacnctatactcgcagactccgtggacgggccgtattccgaccactcctccagacgaacaacttaccaaagaacgaccggtagtatactactaaatagaacacgcctagacgacgccgatacgaccgacgcgtacgtattacgtagtgtagacgatataaactcgaacgccggacggggtacaaccgaacgtacgtaacg

SEQ ID NO: 367134 - DNA, 748 bp, Homo sapiens
  misc_feature: GZ8MTXP02GV48E.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagacgtggaggagccttgatccaggccgtcgggggtccctgagactctcctgtgcagtcctcgtggttccaccgtcagtagacaagtacatgagcgtcggtccgccgagggcctaccggaggggaacggggtcgtaggggagtgggacttcgtacgtagtttatttatcgtaccggttaggtaacacacttacacgcacgtacctcggtgggacgggtccgtactttaccgaacctactcccgtaccgaaggaaacgtaacctaaacgtttacccgaaaacggtaaaccgttaacggggttacgttaacttaccctttaaaacgaaacgttaacggaaaaccgaacgtaccccgttagggaaacgtaacggacccggtaagtaccggaaccgtaccgggttacccgttgttaaaaccgtttcgtaggttagtaacggtaaagaaacgttaaaccctaaaaacgtaccggtaaaccggtccggggtacccgggggttaaccctaaaaccccggtaaaaagttccggtaaaccggttacccggtaaacccggggg

SEQ ID NO: 367135 - DNA, 627 bp, Homo sapiens
  misc_feature: GZ8MTXP02FT32W.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagctctcctgtgcagcctctgggttcaccgtcagtagcaagtacatgagcgtgggtcccgccgaggccgtccggggaaggggctgggagtggattcgtcgtagttatttatccgtcggtgtaaacactataccgtacgcgaacgtacgttccgggtagggacgggcccgtattccacctactcctaccgaagaacgaactaaacttacccgaaagaaccgtaacgggtagttaacttaccttacctaaaattacggaaacacgtaccgtagaacgtacgacccgagtacgacgacggtccgtagttacgttacgtggtgtagagtactaactaaacttaccgaacggcccggtacgggggtaccaaccgtaaacgtacgaacgtaaccggg

SEQ ID NO: 367136 - DNA, 580 bp, Homo sapiens
  misc_feature: GZ8MTXP02JST4J.22.11.A11.1.454.CMB.2.raw
  modified_base (338)..(338): a, c, t, g, unknown or other
  modified_base (379)..(379): a, c, t, g, unknown or other
  modified_base (437)..(437): a, c, t, g, unknown or other
  modified_base (514)..(514): a, c, t, g, unknown or other
  modified_base (522)..(522): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccgagccgtgggggtccctgagactctcctgtgcagcctctgggttcaccgtcagtagcaagtacatgagcgtggtccgcgaggctcgaggggacgggctggaggtggatcgtctagtttnttactcgtcggtagtaacacatactcgcacgaccttccggngggacgggcctattcaaaccctgtctacagacgactaacttacaaagtacacgggttntacttacttacaaatcgaaacaggacctaggaacgacgaccgacgacgaaccgtcgggaccgttagtacgtttaggngtacgganaacgtactaacgaaaccgtcggacggccgggtacggtaccaaccgtaacgtcggaacg

SEQ ID NO: 367137 - DNA, 689 bp, Homo sapiens
  misc_feature: GZ8MTXP02IPVDO.22.11.A11.1.454.CMB.2.raw
  modified_base (247)..(247): a, c, t, g, unknown or other
  modified_base (375)..(375): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctattcaaaggtgtccagtgtgaggtgcagctggtggagactgggaggagccttgatccagccgtgggggtccctgagactctcctgtgcngcctcgtggttccaccgtcagtagcaagtacatgagcgtcgggtccgccgaggcctaccggaaggggaaggggctgggagtgggatctacgtagtttattatcgtcggtagtaaccatatactacgcngcctcggtggacgcgattaccactatccctaccgaagaacgaactaaacttaccgaaacgtaaaccgtaccggtaattaacttactttaaacgaaaacgttacgaaaaccgtacgaccccgttaagggaacggtaacgacccggaagttacggaaccacccggggttccgtaagttaacgtttacgtagggttagtaagggaacgtaacgttaaacctaaaacgtttacccgaaacggtccccgggggtaacccggggttaaccaaaaccccggtaaaatttaccggaaaccggtttacggggtaacccggggg

SEQ ID NO: 367138 - DNA, 580 bp, Homo sapiens
  misc_feature: GZ8MTXP02GC1K4.22.11.A11.1.454.CMB.2.raw
  modified_base (361)..(361): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgccgaggctccgaggggaaggggctggagtggatctcagttattatctccggtgtaacacatactacgcngactccgtggagggccgattcacatctccagagacaatccaagaacacggtgtatcttacaaatagaacagcctgagacgaccgatacggactaaccgggcccgtagttaattaccgtaggttagtaggaaggtaactactaaaaacgttacccgtaaaggcccggtaccggggggtaccaaaccccgtaaaagttacgaaccgtacggttaccggggg

SEQ ID NO: 367139 - DNA, 669 bp, Homo sapiens
  misc_feature: GZ8MTXP02F8JIE.22.11.A11.1.454.CMB.2.raw
  modified_base (251)..(251): a, c, t, g, unknown or other
  modified_base (265)..(265): a, c, t, g, unknown or other
  modified_base (270)..(270): a, c, t, g, unknown or other
  modified_base (369)..(369): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttcctgttgctatttcaaaggtgtccagtgtgaggtgcagctggtggagacgtggaggagccttgactccaggccgtgggggtccctggagactctccgtgtgcngcctcgtgggttcnccgtnagtagcaagtacatgagcgtgggtcccgccgaggccgtaccggaggggaacggcgtagggagtgggatcgtctagttattacgtcgtacggtagtaacnctactactacgcacgacgtccggtgggaacgggtccgtaattccgacctatcctacccgaagacgaactaacttaaccgaagtaaaccgtacggtagtaacttcgttaaagaaacttacgaaaccgtacgtccctagggaacgaaccgacggtacgtacggaaccgaccgggtaccgttagttaacgttacgttaggtacggtagaaggtaactaaccgtaaaacgttccgaaaaccggccggtaaacccgggggtacaaaacccggtaagtttaccggaaccgtacggtaacccggggg

SEQ ID NO: 367140 - DNA, 536 bp, Homo sapiens
  misc_feature: GZ8MTXP02FUF2C.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgcaggctccgaggggaaggggctggagtggatcgtcagttatttatctccggtgtaacacatacctacgcagacctccggtggagggccattcaccatctccagagacaattaccaaagaacacggtgtatcttacaaatagaacagcctagagagccgatgacacggccgtgtatactgtgtgagactacaaaacttccaacgccggcgggggtaccacccgaaattcgaacgtacgtacgggg

SEQ ID NO: 367141 - DNA, 658 bp, Homo sapiens
  misc_feature: GZ8MTXP02H8GJG.22.11.A11.1.454.CMB.2.raw
  modified_base (286)..(286): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtgggggtccctgagactctcctgtgcagcctcgtggttccaccgtcagtagcaagtacatgancgtcgggtccgccgaggctaccgaggggaggggctagggaggtgggatctcgtagttttattagttcgtccgggtagtaaccacatactacgcagtaccgttcggagggtacgggccgtacttcaccattccaccagacaacgaattaccgaaacgtaacgacggtacgttaatcttaaccaaagttacgaaacgacgtacccgtaggacgacgaccgagtacggacgaaccgggtcgtacgttaacgtttacgtaggttaggttacgaacgtaaagtaactaaaaaccgtttccgaaaaccggttcccggggaccgggggtaacccaaacccggttaaaagttcggtaaccgttaacgggtaacccggggg

SEQ ID NO: 367142 - DNA, 823 bp, Homo sapiens
  misc_feature: GZ8MTXP02HZQNS.22.11.A11.1.454.CMB.2.raw
  modified_base (305)..(305): a, c, t, g, unknown or other
tcagacatacgcgtcacgaccggtgctcgatttagctacgactgcaggggggagaggagcccagcactgggattccgaggtgttcccattcggtgatcagcactgaacacagaggactcaccatggagttttggctgagcttgggttttccttgttgcttatttacaaaaggtgtccagtgtgaggtgcagctgggtggagacgtgggaggagccttgatccgaggccgtggggggtccctgagactctcctgtgcagccttcgtgggttccaccgtcagtagcaagtacatgagcgtgggtccnccgagggcctaccggaggggaaggggctgggagtgggatcttacgtagtttattacgtcgttacgggtacggttaaaccactaacttaaccgacggtacctacgggtacccgttaccgggtagggggtaaccgggggtcccgtaacgtttacccaaacccgtacttacccgtacccccgaaagaaacggaaacctaaaaccgtttaaccccgaaaaacgggttaaaccgtaaaccgggggtttacgttaaacttacccgtttaaaactaaaaacgttacggaaaacccgtaacggtaccccgttaagggaccggtaaacgggtaccccggaaagttaccgggaaaccggtaacccgggttacccgggtttagttaactttaaccggtggtttagggtacgtaaaggtaaacttaaacgtaaaaacgtttacccgaaaacgggtaacccccgggggtacgggggtaacccctaaacccgtaaaagtttccggtaaaacctttaccggggaacccggggg

SEQ ID NO: 367143 - DNA, 299 bp, Homo sapiens
  misc_feature: GZ8MTXP02GMSQ7.22.11.A11.1.454.CMB.2.raw
  modified_base (275)..(275): a, c, t, g, unknown or other
  modified_base (282)..(282): a, c, t, g, unknown or other
  modified_base (294)..(294): a, c, t, g, unknown or other
  modified_base (296)..(299): a, c, t, g, unknown or other
tcagacatacgcgtcacgaccggtgctcgatttagctacgactgcaggctgctgatggtgagagtgaattctgtcccatcaaggttcagcggcagtggatctgggacagaattcactctcaccatcagcagcctgcagcctgatgtattttgctaacttattactgaccaacagtataatacttattcgtggacgttcggaccaagggaccaaggtgaaaatcaaacgactgtgctgcacatctgtctcatctccgcatctagacgcgtatgtcngagcggntggcaaggcganannnn

SEQ ID NO: 367144 - DNA, 536 bp, Homo sapiens
  misc_feature: GZ8MTXP02FTUUY.22.11.A11.1.454.CMB.2.raw
  modified_base (355)..(355): a, c, t, g, unknown or other
  modified_base (365)..(365): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtgggtcccgccaggcctccgaggggaaggggctgggagtggatctcagttatttatctcggtgtaacanatactacgcngactccggtggacggcctattcaccatctaccagacgacaattaccaagaacacggtgtatcttacaaatagaacagcctagagacgccgatgacgacggccgtgtatactgtgtagagatacaaaactcaacgccggacggggtaccacctaatacgactacgtacgggg

SEQ ID NO: 367145 - DNA, 571 bp, Homo sapiens
  misc_feature: GZ8MTXP02FKRYU.22.11.A11.1.454.CMB.2.raw
  modified_base (365)..(365): a, c, t, g, unknown or other
tcagacatacgcgtcacgaccggtgctcgatttagctacgactgcagggggggagaggagcccagcactgggattccgaggtgttcccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgaggggaggggctggaggtggatctctagttatttatctccggtggtaacacatacgtaccgnacgactcccggtgggacggggccgtattcaccatctccagagacaattaccaaagaacacggtgtaactcttacaaatagaacagacctgagacgaccgatagaccgacggcccgtgtattacgtgtgtagaagtataactaaaacttccgaaaggccggacgggggttaccaaccctaaaagttcgaaacgtacggtaccggggg

SEQ ID NO: 367146 - DNA, 663 bp, Homo sapiens
  misc_feature: GZ8MTXP02INF1R.22.11.A11.1.454.CMB.2.raw
  modified_base (527)..(527): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagcgtggtggagacgtgggaggagccttgatccgagccggtgggggtccctgacgactctccgtgtgcagcctcgtggtcaccgtcagtagacaagtacagtgagtcgtcgggtccgccgaggccgtaccggaaggggaacggggcgtagggtaggtggtattccgtcgtaagttttactttagtcgtacgggtaggtaaacactaactactacgcaacggtaccgtccggtggggacgggacctacttaccgacctacgtcctacgagtaacgaaacctaacttaaccgaaagtaaaccgacggttacttaacttaccttaaacaaacgtagaaacngacctagacgacgacgtaacgacggaaccgtacggaccgttaggttaactttaccggtgttaggtacggtagtaactaaactaaaacgttccgaacggccgggtacggggtacaaacccgtaagtacggtaaccgg

SEQ ID NO: 367147 - DNA, 733 bp, Homo sapiens
  misc_feature: GZ8MTXP02GDIPI.22.11.A11.1.454.CMB.2.raw
  modified_base (266)..(266): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttcctgttgctatttcaaaaggtgtccagtgtgaggtgcagctggtggagactggaggagccttgatccgagccgtgggggtccctgagactctctgtgcagcctgtggtcaccgtnagtagcaagtacagtgagcgtcgggtccgcgacggcctccggaagggacggggcttacggggagtggatccgtacgtagtttacgttactcgtacgggttagtaaaccacgtaacgttacgtaccgctaacggtaccgtccggtagggacgggtaccgtattccgaaccgtacgtccgtacgacgtaacgtaacgtaacgttaccgaaacggtaacgtaccgggttagtaacttaccggttaactaaaacgttacgtaaaaccgtacggttaccccgtaaggtaacggtaaccggtaccccggtaaggttaccggtaacccggtacccggggttaccggttaacggtttaacgtttaaacccgttggtacggttacggtaacgtaacgttaaccgtaaaaccgtttaaccgaaacggtcccgggtaccgggggttacctaacccggtaaacgtttcggtaaacccgg

SEQ ID NO: 367148 - DNA, 697 bp, Homo sapiens
  misc_feature: GZ8MTXP02IMMF3.22.11.A11.1.454.CMB.2.raw
  modified_base (571)..(571): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgatccgggccgtgggggtcctgagactctcctgtcgcagcctcgtgggttccaccgtcagtagacaagtacatgacgtcgtcggggtccgccgacggccgtaccggaggggaaggggcgtgggacggtggatcgtactagtttattatcgtacggtacggtaaactactaataccgtacgacaacgtccgtccgggtaggacgggggtaccctaacgttacaaccctacgtcctacccgaacgtaacgaactaaacgttaacccgaaaacggaaaccgtaacggttaacgttaacgttaccttaacgtaaaaacgtacgtaaacgtaacggaccgtaggaacgggacgacccggtanacggaacgacggtaccgttagtattacgttcgtgtagagtaataaactaaaacgttccgaacggcccggtaaccggggtaacctaacccgtaaacgtacggaaccgttacggaccggtaacccggg

SEQ ID NO: 367149 - DNA, 779 bp, Homo sapiens
  misc_feature: GZ8MTXP02HCWI5.22.11.A11.1.454.CMB.2.raw
  modified_base (254)..(254): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctntgggtcaccgtcagtagcaagtacatgagcgtcgggtccgccgagggcctaccggaaggggaaggggctaggggaggtggacttcgtacgtagtttatttagtcgttaccggtacggtaaacactatactacgcagtaccgtccggtcggggacgggccgtacttccacccgatccctaccgaagaacgaacctaaacgtttacccgaaaacgtaaccgaaccggggttagtaacttacccgtttaaacaaaacgtttacggaaaaaccgttacggtaaccccgttaagggaaacggtaaccggaaccccggtagttaaccgggaaacccggtaacccggggtacccgtttaaggttaaaccgttttaaaccggttggtttaggtaaacggggtaataaaccgtttaaacgtaaaaaaccgtttcccggaaaaaccgggtccccggggtaaccgggggttaacccctaaaaacccggttaaaacgtttaccgggaaaacccgtttacgggttaaaccccgggggg

SEQ ID NO: 367150 - DNA, 744 bp, Homo sapiens
  misc_feature: GZ8MTXP02ISO3N.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtggaggagccttgatccagccgtgggggtccctgagactctcctgtgcagtcctcgtgggtcaccgtcagtagcaagtacagtgagcgtcgggtccgccgaggcctaccggaaggggaacggggctgggaggtaggacttcgtacgtaagtttatttacgttcgtacggtagtaaacactaactacgtacgacacgtaccgttacggtaggggacggtaccgtacttaccaacctactcctacccgaaagtacgaaacctaaacttacccgaaaacggtaaccgtacgggttactaacttacgttaaacctaaaagttaacggaaaaccttacggaccccgttaagggaaacgaaccggacccgtaagtacgggaaccccgaccggggtacctttagggttaactttaaccggtggtttacggacgtaaagttaaacttaaaccgtaaaaacgttcccggaaaacgggtccccggggtacgggggttaacccctaaaacccggttaaaagtttccggaaaaccggtttaccggaacccggggg

SEQ ID NO: 367151 - DNA, 760 bp, Homo sapiens
  misc_feature: GZ8MTXP02JIMVS.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctccgtgtgcagcctcgtgggttcaccgtcagtagcaagtacatgagcgtcgggtccgcaggctaccggaggggaaggggcgtgggagtgggattctacgtagtttatttaacgtcgtaccggttaggtaaacactaacttacgaccgcgagtaccgtccggtagggacggggaccgtaatttaccaaccctaacttcccgtaccgaaacgaacggtaaacctaaaacgtttacccgaaaacggtaaaccgtaaccgggggttagttaaactttaccgttaaacctaaaaagttacggaaaaccctacggtaccctaagggtaaaggaccgtaacccggaagttacgaaaccggtaacccgggtacccggttaaggtttaacttaaccgttaggttggtaaccggttaaggaaactttaaaccgtaaaaacgtttccggaaaaccggccccggggttaccgggggtaaaccctaaacccccgtaaaagttcccggtaaaccgtttacggggtaacccggggg

SEQ ID NO: 367152 - DNA, 662 bp, Homo sapiens
  misc_feature: GZ8MTXP02F43XL.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcacgcctcgtcgggttccaccggtcagtagacaagtacatgagcgtcggtccgccgaggcctccggaggggaaggggcgtagggagtggatctacgtagtttatttagtcgtccggtacggtaacacgtactacgtaacgcacggacctccggtaggggaccgggaccgtacgtttaccaccctacgttcctacccgaagtaacgaactaaaacgttacccgaaaggaacctaacggggtctaactcttaaacaaattacgaaacacgaccgtagaacgacgaccgtagtcgaacggacggtaccgtgttacttacgtgttaggtgaagtaactaacgtaaaacgttccgaaacggtcccgggtacgggggtaaccctaaccgtaagtaccggaaccggttacggtacccggggg

SEQ ID NO: 367153 - DNA, 825 bp, Homo sapiens
  misc_feature: GZ8MTXP02GZZDG.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagtcttgggttttccttgttgcttatttacaaaaggtgtccagtgtgaggtgcagctgggtggagacgtgggaggagccttgatccgaggccggtgggggtccctgacgacttctcctgtcgcacgtcctcgtcggttccaccgtcaggtacgacaagtacagtggacgcgtcgggtcccgccgagggcctaccggaagggggaacgggtcgtagggaggtgggactccgtacgtaagtttatttacgtcgtacggtacggtaaacctacgtaactaccgtacgacacggtacccgttcgggtacggggaccggacccgtaactttacccgaaccctacgtacccgtacccgaaagaaacgtaacctaaaccgttaaacccgaaaacggtaaaccggtaccgggttaactttaaacgttaccgtttaaaacctaaaagttaaaccggaaacgtaacggttacccgtaagggaacggaaaaccggaccggaaacgtaaccgggaaaccgtaacccggggtacccggtttaagttaaactttaaccgggttagttaggtaaacggtaaaggtaaaccgtttaaaaccaaaaaaccgtttcccggaaaaccgggttaacccggggaacccgggggttaaccaaaaccccggtaaagttaccggtaaaccggtacgggtaaaccccggggg

SEQ ID NO: 367154 - DNA, 612 bp, Homo sapiens
  misc_feature: GZ8MTXP02IB3YS.22.11.A11.1.454.CMB.2.raw
  modified_base (291)..(291): a, c, t, g, unknown or other
  modified_base (510)..(510): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagccttgtggttcaccgtcagtagcaagtacatgagctgggccnccgaggctccgaggggaggggcgtaggagtggatcgtactagtttattatcgtccggtagtaaccactatacgtacgctacgccgttcggaggacggcctagttaccacccattccaccgtagacgaactaacttacgaaagactacggtatactacgtaacaatagaacctagccctaggagacgacgtatagacctacgggtcctagttaacttcgnggttagatacggaacttaaccgtaaaacttcccgaacgggaacccggtccggggtaaacctaaccccggtaaaagtttccgaaaccgtttacggaccggggg

SEQ ID NO: 367155 - DNA, 775 bp, Homo sapiens
  misc_feature: GZ8MTXP02IHH5I.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaggtgtccagtgtgaggtgcagctgggtggagactgggaggagtccttgatccagccggtgggggtccctgagactctcctgtgcagcctgtggtcaccgtcagtagacaagtacatgagtcgtcgggtccgccgaggcctaccggaggggaaggggtcgtagggtaggtcggacttccgtacgtaaggtttaactttacgtaccggttccgggttaaggttaaacctaacgtaaccgttaaccgttacccgggacctaacgggtaaccccgtttacccggggttacgggggaaccggggtaccccgtaaactttacccgaacctacgttacccgttaccggaaacggtaacgtaaacccgtaaaccgtttaacccgaaaaacgtaaacccggttaacggttacggttaaactttacccggtttaaacaaaaacgttacgaaaaccgtacgggtacccgtaggaacggacgacggtaactacggaacgaaccgggtccgttaaggttaaacttcgtagttagagtaacgtaacttaacgtaaaaccgttccgaaaccggtaccgggtaccggggtaaccaaacccgttaaaagtacgtaaacccgg

SEQ ID NO: 367156 - DNA, 630 bp, Homo sapiens
  misc_feature: GZ8MTXP02H0O4V.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctgggtggagacgtgggaggagccttgatccgagccgtgggggtccctgacgactctcctgtcgcacgcctcgtgggttccaccgtcagtacgacaagtacagtgagtcgtcgggtccgcgaggccgtacggaggggaagggcgtgggagtggatctatagtttatttctcgtacggtagtaacactatactcgacacgtaccgttccgggtaggacgggaccgtatacccactatcctacagaacgactaaactaccgaaacgaacgtacgtacgtacttactacgaaattacgaacacgtccgtagagacgtacgatacgaccgtaccggtcgttagtactttagtggttagtacggtaagacttaaacgtaaaacgttaaccggaaacggtccggggaccggggtacctaaacccggtaagtttaaccggaccgg

SEQ ID NO: 367157 - DNA, 601 bp, Homo sapiens
  misc_feature: GZ8MTXP02FMYTA.22.11.A11.1.454.CMB.2.raw
  modified_base (252)..(252): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgaggccgtgggggtccctgagactctcctgtgcngcctgtggttcaccgtcagtagcaagtacatgagcgtgggtccgcaggctaccgaggggagggctgggagtggatcgtctagttatttagtcgtcggtagtaacatatactacgcacgactccggtaggacggccgtattccgacctatcctaccagacgaacaacgttaccaaacgtaaccgtacggttagtactacttaacaaagtcgaaacagccgtagacgacgaccgagtacgacgaccggtccgtagtacttacgtgtggtagtacgtaactaacgtaaaacgttccgaaacggccggtaccggggtacctaacccgtaagttacgaacgtacgtaccggggg

SEQ ID NO: 367158 - DNA, 735 bp, Homo sapiens
  misc_feature: GZ8MTXP02F2DEO.22.11.A11.1.454.CMB.2.raw
  modified_base (300)..(300): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcacgcctcgtggggttcaccgtcagtaagaaagtacatgagcgtcgggtccncgaggctccgaggggaagggctggagtggatctctagtttattagtcgtcggtaggtaaacactatacctacgacaagtacctccggtaggggacgggtcccgagttacaccctatcctacccaagtacgaactaaacttacccgaaaacgaacctaacggggttacgttaactaccgttaaactaaaaacgttacgaaaaccgaacggtaccgtacggaaacgggaaccggacccggaagttacggaaacccggtaaccgggtcccggttaaggtttaacgttaaccgttacggttaggttaggaaacggttaaacgtaaacctaaaaacgtttacccgaaaacgggtaccccggggtaacgggggtttaccccaaaaccccggttaaaagttccggtaaaaccgttaccggggtacggggtaaacccccgggg

SEQ ID NO: 367159 - DNA, 722 bp, Homo sapiens
  misc_feature: GZ8MTXP02GSDJS.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagctaagtacatgagcgtcggtccgccaggctaccggaggggaaggggctgggagtgggatctacagtttattatcgtcggtagtaacactatacgtacgcacgactcggtagggacggccaagttccaccaagtcctacccgagaacgaactaaaacttacccgaaacgtaaaccgtaacgggttacgttaaacttacctttaaacgtaaaaacgttacggaaaacccgtagtaccccgttaagggtaaacggaaccggtaaccccggaaagttaacggtaacccgaaccgggggtaccccggttaagggtttaaactttaccggtacgggtttaggtacgggtaaagtaaacttaaccgtaaaaaacgttcccggtaaaacgcccgggggtccgggggttaaccaaaaccccgtaaaggtttacggaacccgttacgggttaacccggggg

SEQ ID NO: 367160 - DNA, 748 bp, Homo sapiens
  misc_feature: GZ8MTXP02HRUSR.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtgggaggagccttgatccagccggtgggggtccctgagactctctgtgcagcctgtggttcaccgtcagtagacaagtacagtgagcgtcggggtccgccgaggccgtaccggaagggggaacggggtcgtaggggagtgggtactcgttacgtagtttatttacgtcgttaccgggtaggtaaaccactacttaacgtaccgcacggtaccgtccggtagggaccggggtccgaactttaccgaaccctacgttaccctacccgaaagaacggtaaaccttaaacctttaacccgaaaacggtaaaccgtaccggggttattaacttacctttaaacgaaaacgttacgaaaccgtacgaccttaagggacgaaccgccggtaagacggaaccggtaccgggtaccgtagttaaacgtttcgtaggttggtagtaaacggtaattaaaccgtaaaaccgttcccggaaaacgggtaacccggggtaccgggggtaaccctaaaaccccgtaaaagtttaccggaacggttaccggtaaccggggg

SEQ ID NO: 367161 - DNA, 647 bp, Homo sapiens
  misc_feature: GZ8MTXP02FTWPL.22.11.A11.1.454.CMB.2.raw
  modified_base (462)..(462): a, c, t, g, unknown or other
  modified_base (553)..(553): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagcgtgggtggagacgtggaggacgtccttgactccgacggtccggtcgggggtccctgacgtacttctcctgtgcacgtcctcgtgggttccaccgtcagtagacaagtacagtgagtcgtcgggtccgcgaggcctacggaggggacgggtctgggagtggactcgtacgtagttattactcgtacggtacgtaacactatactacgacagtccgtcggtaggacggctactcactatcgacagacactaatacccgaaagtaccgaggttanaacttctaaacgaaaagtcgaaacacgtcgtaagggaacgaccgaccgtaagtcggaaaccgacggggttaccttagtaaacctttacggnggtagtaacgaaactaaacgtaaaccgtaaaccgtccggaaccggccggggtaaccgtaactaaaccggtagtacggaaccggtacgggacggg

SEQ ID NO: 367162 - DNA, 535 bp, Homo sapiens
  misc_feature: GZ8MTXP02H4YVC.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtcccgccaggctccgaggggaaggggctgggagtggatctcagttattatcgtccggtagtaacacgatactacgcagactcggtggaggccgattcaccatctccagagacaattacaagaacacggtagtatcttacaaatgaaacagacctgagagccgatgacgacggccgtgtattacgtgtgtgagatacaaaacttcgaagccggacggggacctacccgaaagtcgactacgacgggg

SEQ ID NO: 367163 - DNA, 644 bp, Homo sapiens
  misc_feature: GZ8MTXP02JBRW7.22.11.A11.1.454.CMB.2.raw
  modified_base (457)..(457): a, c, t, g, unknown or other
  modified_base (484)..(484): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagtcgttgggttttccttgttgctatttacaaaggtgtccagtgtgaggtgcagctggtggagactgggagagccttgactccagtccgtgggggtccctgacgactctcctgtgcagcctgtggttcacgtcagtagcaagtacatgagcgtggtccgcgaggctacgaggggagggcgtgggagtggatcgtcgtagtttattactcgtacggtagtaaactcgtaatactacgcagtaccgttcccggtagggacgggaccaacgtcaaccgtatcctaccgagaagaactactaccgaaagaccgtaacggtnttactacttacaaaagttcgaaaccgngacctaggaacgacgtaccgtagaccgaccgtaccggtcgttaacgttacgttacggtggttaacggtacgtaaacgtaacgttaaaccgtaaaacgtaaccggtaaaccgggtcccgggtaaccgggtaccctaaaaccgttaacggttaccgtaacgg

SEQ ID NO: 367164 - DNA, 612 bp, Homo sapiens
  misc_feature: GZ8MTXP02F2FM0.22.11.A11.1.454.CMB.2.raw
  modified_base (256)..(256): a, c, t, g, unknown or other
  modified_base (357)..(357): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccgggccgtggggggtccctgagactctcctgtgcagcctcngggttcaccgtcagtgcaagtacatggagctgggtcccgccaggcctccgaggggtaaggggctggagtggatctctagtttattatcgtcggtgtaaacncatactacgcagactccgtgggacgggccattccacctatcctccagagacaaacttccaaagaaacgtacggtagttaactacctttaacaaaactagaaaccaaggccctagaacggacgtacccggatacggaacgaacgggcccttaggttacttaagtggtagtagagtaaatacctaaaattaccgaaacggtcccgggaacgggggtaccaaacccgtaagttacgaaccgtacggtcgggaacccgg

SEQ ID NO: 367165 - DNA, 705 bp, Homo sapiens
  misc_feature: GZ8MTXP02HLU0I.22.11.A11.1.454.CMB.2.raw
  modified_base (381)..(381): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgagccgtgggggtccctgagactctcctgtgcagcctctcgggttccaccgtcagtagcaaagtacatggagtcgtcgggcccgccgtaggcctaccggaggggaggggcgtgggagtgatctactagtttattactcgtcggtacgtaacacaacttacncgtacgacgtacgtccgtaggggacggggcctacgtccaccctagtccctaccgaagaacgtaaacctaaacgttacccgaaaacgtaaaccgacggggttataaactttacctaaaccgttaaaagttacgaaaacgtacggtacccgtaggaacggaacggtacccgaagttacggaaccggtaccgggtacccgttaggttaacgttaccggtaggttacggtacgtaaggtaacttaaacccgtaaaacgttaacccggaaacggtacccgggggacccgggggttaccaaacccgtaaacggtttacggtaaaccccgg

SEQ ID NO: 367166 - DNA, 733 bp, Homo sapiens
  misc_feature: GZ8MTXP02GWYLA.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccgagccgtgggggtccctgagactctcctgtgcagcctcgtggttcaccgtcagtagacaagtacatgagcgtcgggtccgccgaggcctaccggaggggaacggggcgtagggaggtcggattctacgtagtttacttacgtcgtacggtacggtaacactaatacgtcgacgacggtaccgtccggtaggggacgggtccgtaacttcccaaccgtactaccgtaccgaagtaacgaaacctaacgttaacccgaaaacggtaaaccgacggggttattaacgttaccttaaacgaaacgttacgaaaccgttacggacccgttaaggtaacggaacgacccggtaacgtacggaaaccggtaccggggttacccgttaggttaacgtttaccgttagggttacggtaaggaacgtaaactaaacccgttaaaaacgttaacccggaaaccgggtacccggggtaccgggggtaaccctaaaacccggttaaacgttacggtaaaccccgggg

SEQ ID NO: 367167 - DNA, 545 bp, Homo sapiens
  misc_feature: GZ8MTXP02IX2IA.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctgggttcaccgtcagtagcaagtacatgagctgggtccgccaggctccgaggggaagggctggagtggatctctagtttattatctcggtagtaacactatactacgcagctcgtgggacggccgatcacatctacagagacaataccaaagaacacggtagtactacttacaaatagaacagactgaagacgcgagtcgacgacggacctgttattacgtgtgtagagtactactaaaacttaccgaacgccggacggggtaccaaccgaattcgaactacggtaccgggg

SEQ ID NO: 367168 - DNA, 661 bp, Homo sapiens
  misc_feature: GZ8MTXP02F1HJ1.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtgggggtccctgagactctcctgtgcacgcctcgtgggtcaccgtcagtagcaagtacatgagtcgtcgggtccgccgaggccgtaccggaaggggaaggggctagggagtggatcgtcgtagtttatttacgtcgtcggtagtaactacgtaactacgtacgctaacgtacgtccggtaggggacgggcccgtattacccgaacctataccctacaacgaacgaacctaacttacccgaaaacgaaccgtacggtacgttaacttaccttaacaaaacgttcaaaccgacgaccctaaggacgacgaccgagtacggaaccgaccggtacgttacgttactttacgtggtagtagtacgtaactaactaaaaacgttaaccgaacggtacccggggtacggggtaacccaaaccgtaaacgttacgtaaacccgg

SEQ ID NO: 367169 - DNA, 665 bp, Homo sapiens
  misc_feature: GZ8MTXP02HMAMZ.22.11.A11.1.454.CMB.2.raw
  modified_base (297)..(297): a, c, t, g, unknown or other
  modified_base (320)..(320): a, c, t, g, unknown or other
  modified_base (331)..(331): a, c, t, g, unknown or other
  modified_base (358)..(358): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccggccgtggggggtccctgagactctcctgtgcagcctcgtgggttccaccgtcagtagcaagtacatgagctgggtcccncaggcctccggaggggaggggcnggagtggatcntaagttattagtcgtggtacgtaaacnctataactacgacagtaccgtccggtagggacgggtccgtaacgtttcaaaccctactacctacccgaaggtaaacgaactaaacttaaccctaaaacggaaaccgtaacgggttacgttaacttaccttaacaaaagttacgaaaactacgtacctaggaaggacgaccggtacacgaacgtaccggtccgtagtacttaacgtgttgtagaacgtacgtaactaaaacgttaccgaacggcccgggtaaccgggggttaccaaacccgttaaacgtacgaacgttacggtaacgggaaccccggg

SEQ ID NO: 367170 - DNA, 579 bp, Homo sapiens
  misc_feature: GZ8MTXP02FH4SI.22.11.A11.1.454.CMB.2.raw
  modified_base (365)..(365): a, c, t, g, unknown or other
  modified_base (436)..(436): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagctgggtccgcaggctccgaggggaggggctggagtggatctcgtagttatttatcgtcggtaggtaacacatactacgcngacctcggtggacgggctattcaccatctccagacgacaactacaaagaacacggtgtatcttacaaagtnaacagcctaggagacgccgatacgacgacggtccgtgtattactagtgtacgtaagactaacgaaaacttacccgaacgggtcccgggaccgggggttacccaaaccccgtaaaatttacggtaactaccggttacccggggg

SEQ ID NO: 367171 - DNA, 705 bp, Homo sapiens
  misc_feature: GZ8MTXP02JCWHW.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgcttatttcaaaggtgtccagtgtgaggtgcagctggtggagacgtggaggagccttgactccaggccgtgggggtccctggacgactctcctgtgcagcctcgtgggttccaccgtcagtagcaagtacagtgacgcgttcgggtccgaccgacgggtccgtacccggaagggggaacggggcgtaggggtagtggggattccgtacgtagttttatttacgtcggttccgggttaacggtaaacctacgtagttaacctaccggacacggtaccgttccggtgggggaaccgggtacccgtacgtttcccaaaccctactccgtaccgaagaacgaacctaaacgttaaccaaacggtaaaccgtacggttacgtacttaccttaaacaaaagtacgaaactacgtaccgtaggaacgacgaccggacgtacgaaccgacggtaccgttagttaacgttcgtaggtcgtagaagtaactaacgtaaaacgttccgaaacggtccgggacgggtaccaaaccgtaagtcgtaacgacggtacccgggg

SEQ ID NO: 367172 - DNA, 548 bp, Homo sapiens
  misc_feature: GZ8MTXP02F2ZFL.22.11.A11.1.454.CMB.2.raw
  modified_base (295)..(295): a, c, t, g, unknown or other
  modified_base (360)..(360): a, c, t, g, unknown or other
  modified_base (369)..(369): a, c, t, g, unknown or other
  modified_base (429)..(429): a, c, t, g, unknown or other
  modified_base (460)..(460): a, c, t, g, unknown or other
  modified_base (477)..(477): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtgggtccnccgaggctccgagggaaggggctggagtggatctctagttattatctcggtgtaacacatacacncagctcggnggacggccgtattccgacactctccagagactaattaccaagaacacggtgtactcttanaaatagaactagcctagagacgccgatgacncggccgtgtatactgtntgagatactaaaacgttcgaaacggccggtacggggtaccaaccgtaaagttcgacgtacggtaaccgggg

SEQ ID NO: 367173 - DNA, 555 bp, Homo sapiens
  misc_feature: GZ8MTXP02H4099.22.11.A11.1.454.CMB.2.raw
  modified_base (360)..(360): a, c, t, g, unknown or other
  modified_base (488)..(488): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagctggtccgcaggcctccgaggggaaggggctagggagtggatcgtcagtttatttatcgtacggtggtaaacncattacctagcagacctccgtggacggccatcacatctacagagactaattccaagaacacggtagtatacttacaaagtgaaacagacctagagagccgatacgacacggccgtagtacttactgtnagtacgtagtacaaaacttccgaaacggaccggacgggggtaccaacccgtaaagtttacgaaccgg

SEQ ID NO: 367174 - DNA, 749 bp, Homo sapiens
  misc_feature: GZ8MTXP02JI34T.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttccaccgtcagtagacaagtacatgagcgtggtcccgcgaggcctaccggaggggaacggggctgggaggtgggacttcgtctaagtttatttagtcgttaccgggtagtaaaccactaacttaccgtacgaccgtacggtacccttccgggtaggggaaccggggtccgtaactttaccaaccctaacgttcctacccgaagacgaactaaacgttacccgaaagaaaccgtacgggttatacttaccttaaacaaaaccgttagaaaccgtacgtacccgtagggaacgaacggacccgaagtaccggaaccgtacccggggtacccttagttaacgtttaacggtggtacggtacgggtaagttaaacttaaacgtaaaaccgtttacccggaaaaccgggtccccgggggtaaccgggggttaaaccccaaaacccggttaaaaggttaccggtaaaacccgtttaccggggtaaccccgggggg

SEQ ID NO: 367175 - DNA, 634 bp, Homo sapiens
  misc_feature: GZ8MTXP02HXPS0.22.11.A11.1.454.CMB.2.raw
  modified_base (398)..(398): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggtttttccttgttgctatttcaaaaggtgtccagtgtgaggtgcagctggtggagactggaggagccttgatccagccgtgggggtccctgagctctcctgtgcagcctcgtgggttccaccgtcagtagcaagtacatgagcgtcgggtccgccgaggcctccggaaggggaagggctagggaatgggattcgtctagtttattacgtcgtcggtacgtaacactaatactacgcagctcgtaggacggccgtntcaccatcctacgagagactaaagttaccaaagaaccacggtagtactcgttaacaaattagaaactagacctaggacgagccgtaatcgaacgtaccggtcgtagttaacttaccgttaggtggtaagacggtaaaactaaccgtaaaacttaccccggaaaggtccccggggtaaccgggggtaaccctaaccccgtaaaaagttccggtaaaccgtacggggtaacccggggg

SEQ ID NO: 367176 - DNA, 713 bp, Homo sapiens
  misc_feature: GZ8MTXP02G5H32.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccgagccgtgggggtccctgagactctcctgtgcagcctcgtggtcaccgtcagtagcaagtacatgagcgtggccgccaggcctccgaggggaacgggctgggaggtggatcctgtaaggtttatttacgtccgtcgggtaggtaaacaaccgtaattaaccgtaccgacaacggtacccgttccgggtaggggacgggacccgtaacttaccaacctaactcctacccgaaagaacgtaaacctaacgttaacccgaaaacggaaaccgtaccgggttagtaacttacctttaaacaaaacttaggaaacacggtacccgtaggaaacggacgtacccggaagtacggaaccgtaaccgggtcccggttaagttaaacgtttaccgtttcggtaggttaggtaacggtaacttaacgtaaaaacgtttcccgaaacgggtacccggggaccgggggttaaaccaaccccgttaaaagtttacggtaaacccggg

SEQ ID NO: 367177 - DNA, 755 bp, Homo sapiens
  misc_feature: GZ8MTXP02HVQQS.22.11.A11.1.454.CMB.2.raw
  modified_base (248)..(248): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctcgtggagactggaggagccttgatccagccgtgggggtccctgacgacctctcgtgngacgcgtcctggtcggtacctaccgtcgtagtacacacgtacagacggtacgtcggtccggtccgaccgacggtccgtacgggaagggggacgggtcggtaggggtacggtaggtacttcgtagttaagtttaattacgttcggttaccggttacgtaaaccgtactaacgtaccgttaacgacgacgggtacccgttacgggggtacgggtacccggggtacttaccgttaccaacccgttacgttcccacggaaacgaacgtaaaccttaaccgtaaacgaacgtaccgttaaggtcttaacttactaaaccaagtaaccgacgttagaccgagggaccgtcgacgtagtaccggacgtaaccgggtctttaacgttaacgtcggttagttagggaaactacgttaaactaaaaccggttaaacgtacccgggaaacgggtcccggggtaccggtttaaaaccaaacgttaagtaccgtaaaccgggtttgggaaaccccggggg

SEQ ID NO: 367178 - DNA, 694 bp, Homo sapiens
  misc_feature: GZ8MTXP02I122F.22.11.A11.1.454.CMB.2.raw
  modified_base (336)..(336): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagacgtggaggagccttgatccagccgtggggggtccctgagactctcctgtgcagcctcgtggtccaccgtcagtagcaagtacatgagcgtgggtccgcgaggctaccggaggggaaggggctagggagtggatctntagttacttacgtctacgggtagtaaacacgtaactacgtcgactaacggaccgttccggtaggggacgggcccgtaagttaccgaacctactcccgtaccgaacgacgaaactaaacgttaccgaaaacggtaacgtaaccgttagttaacgttacgttaactaaaacgttcgaaaccgtacgtaccgtaacgacgacggaccgtaagtaccggtaaccgaccggggtacccgtttagttaacggtttactacggttacgttaggaacggttaaactaaaacgttaaaacgttaaccgtaaaccgggcccggtaccgggggtaaccctaaacccgtaaacgtttaacgtaaacccgg

SEQ ID NO: 367179 - DNA, 678 bp, Homo sapiens
  misc_feature: GZ8MTXP02G6G6O.22.11.A11.1.454.CMB.2.raw
  modified_base (298)..(298): a, c, t, g, unknown or other
  modified_base (578)..(578): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactgggaggagccttgatccaggccgtgggggtccctgagactctcctgtgcagcctcgtggtccaccgtcagtagcaagtacatgacgcgtggggtcccnccgagggcctaccggaggggaacggggtcgtagggaggtggacttctacgtagttttattacgtcgttaccgggttaggtaaaccactaactaccgtacgacacgtaccgtcggtacggggaccggggtccgtaaacttccacctactcctaccgagaacgaactaacgttaccaaaggaacctaacggtagttactacttaaccaaaatacggaaacacgaccgtagaacgacgacccgagtacgaccgtacggtccgtagttaaagttcgtagggttntaggaacgtaaactaactaaaaccgttccgaaacggggtcccgggaccgggggttaccaaaaccgtaaagtttaccgaaccgtttacgggaacccggggg

SEQ ID NO: 367180 - DNA, 754 bp, Homo sapiens
  misc_feature: GZ8MTXP02FWODM.22.11.A11.1.454.CMB.2.raw
  modified_base (340)..(340): a, c, t, g, unknown or other
  modified_base (364)..(364): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtgggaggagccttggatccaggccgtcggggggtcctgagactctccgtgtgcacgtcctcgtcggttcaccgtcagtagcaagtacatgagtctgggccgcagggctccggaggggaagggtctgggagtggatcgtntagttattatcgtcggtagtaacnctatacgtacacagacctccggtgggacggggcctatttccgacctatcctacaggaacgaactaaacgttacccgaaacggtaaaccgtacggggttataacgttacctttaaacgaaaacgtttacgaaaaccgtacgaccccgttaagggaaccggaacggtacccgtaaagtacccgggtaaacccggtaccgggtacccggtttaaggttaaccgttttaaccggttgggtttaacgggtaacggttaaaagggtaaactttaaaccggttaaaaaacctttcccgggaaaaccgggtaacccgggggttaaacccgggggtaaccctaaaacccccgtaaaggtttaaccggaaaccggttaaccgggggttaaccccgggggg

SEQ ID NO: 367181 - DNA, 645 bp, Homo sapiens
  misc_feature: GZ8MTXP02H897L.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctggttttccttgttgctatttcaaaaggtgtccagtgtgaggtgcagctggtggagactggaggagccttgatccagccgtgggggtccctgagactctcctgtgcagcctcgtggtcaccgtcagtagacaagacagtgagcgtcgggtccgccgaggccgtaccggaaggggaagggcgtgggacggtggatcgtacaagtttatttacgtcgtacggtacgtaaacactaatacctaccgacaacgtaccgtccggtaggaccgggcctacttaccacacttccgacccgagaacgtaactaaacttacccgaaagaaccgtacggtaactacttactaacgaaatacgaaacacgacgtagaacgtacgaccgaagtacgaaccgacggtacccgttagttaacgttacgtagtacggttacgaagtaacgttaaacaaaacgttaaccgaaacggaccggtaccggggtaaccaaacccgtaagtttacgaaaccgg

SEQ ID NO: 367182 - DNA, 746 bp, Homo sapiens
  misc_feature: GZ8MTXP02HEFAV.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgagccgtgggggtccctgagtactctcctgtgcacgcctcgtcggttccaccgtcagtacgacaagtacagtgagtcgtcgggtccgccgaggcctaccggaggggaacggggcgtaggggaggtggatccgtacgtagtttatttacgtcgtcggtacgtaacacgtacttaacgtacgctacggtaccgtccggacggggacggtccgtacttacccgacctaatccgaccgaagaacgtaacctaaaccgttaccgaaacgtaaaccgtacgggttacttaaacttaccgttaaaacgtaaaacttcgggaaaacctacggggtaacccgttaaggaaacggtaccgggtaacccgaagttaccggaaaccggtaccggggtcccgtttaagttaaaccgttagttacggggtaggtaaggtaaacgtaaacttaaaccgtaaaaaccgttccgggaaaaccggggccccgggggttaacgggggtaacccaaacccggttaaaaggttccggtaaacccggg

SEQ ID NO: 367183 - DNA, 596 bp, Homo sapiens
  misc_feature: GZ8MTXP02JVALK.22.11.A11.1.454.CMB.2.raw
  modified_base (368)..(368): a, c, t, g, unknown or other
  modified_base (387)..(387): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagactggaggagccttgatccagccgtgggggtccctgagactctcctgtgcagcctcgtgggttcaccgtcagtagacaagtacatgagcgtcgggtccgccgagggcctccggaaggggaaggggctggggagtgggatcgtcgtagtttatttatcgtccggtagtaacanactactacgcagcctcggnggaggcctattccaccatctccgagacgactaacttaccaagaacacggtgtactacttacgaaatcgaacacgcctaggacgacgaccgagtacggacgaccggtccgttagtacttaacgtgttaggtgaagtactaaacgtaaaacttccgaaggcccggtacggggtaccaacccgtaagttacggacgttacggtaaccggggg

SEQ ID NO: 367184 - DNA, 649 bp, Homo sapiens
  misc_feature: GZ8MTXP02FIVO9.22.11.A11.1.454.CMB.2.raw
  modified_base (298)..(298): a, c, t, g, unknown or other
  modified_base (436)..(436): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcacgtcctcgtcgggttcaccgtcagtagcaagtacatgagctgggtccnccaggctccgaggggaaggggctgggagtggatcgtctagttattatcgtccggtagtaacatatactacgcagacctcggtgggacgggccgtatccaccatctacccagagactaattaccaaagaacacgggttntaacttacttacgaaatagaaacgacgaccctaggaacgacggacccgtaatacgaccgaccgggtacccgtagttaacgtttaaccgtgggttaggttacgggaaagtaaacgtaaacctaaaaacgttacccgtaaaacggaacccggtaaaccgggggttaacccaaaccccgtaaaagtttacgtaaaccggtacggtaacccgggggg

SEQ ID NO: 367185 - DNA, 763 bp, Homo sapiens
  misc_feature: GZ8MTXP02JOQVR.22.11.A11.1.454.CMB.2.raw
  modified_base (542)..(542): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcgagcgtggtggagacgtggaggagccttgactccgacggtccggtcgggggtccctagacgtactccgtccgtgtcgcgacgtcctcgtcggttccaccgtcagtacgacaagtacagtgagccgtcggtccgcgacggtccgtacggaaggggacgggcgtagggaggtggtacttcgtacgtagtttacttacgtcggtaccggtacgtaacctacgtaacgtacgtacgtacgacgtaccgtcgggtacgggacggtaccgtacttacccgaacctacgtacctacccgaagaaccgtaacttaaaccgttaacgaaacgtaaacgtacggtataacttaccgtaaanaaaacgtacgaaaccgacgttccgaagggaaaccgcgggaaccgtaacgtacgtaaccggaccccgggttagttagttaacccgtttacggtggtaacgtaggaaaaccttacttaaaaaccgtaaaaccggttccgaaaccgggggaaccgggtaacccgggtttaaacaaaacccggttaacgtttacgggaacccgttaaccgggggaaaccccgggg

SEQ ID NO: 367186 - DNA, 707 bp, Homo sapiens
  misc_feature: GZ8MTXP02H0EU5.22.11.A11.1.454.CMB.2.raw
  modified_base (499)..(499): a, c, t, g, unknown or other
  modified_base (508)..(508): a, c, t, g, unknown or other
  modified_base (567)..(567): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggtttccttgttgctattcaaaaggtgtccagtgtgaggtgcagctgggtggagacgtgggagggagtccgttgactccggacggtccgggttcgggggtcctaggacgtctctccgtgtcgcgtacgcctcggttcggtccaccggtcgtaacggtacgacgtaaagacgtagacggcggtcggtccggggtaccccgcggacggtcccgtaaccggggaaggggggaacggggtcggtaggggtaggtagtactacgtacgttaagtttaacttaccgttcggtacgggtaactaacctagtacttaacggctaccgtaacggtcccgttacggggacgaccgggacttacnccaaacctntaccgaccaaaggacctaaactaaccacgaaaacgtccgtagttatacttacgtaaaanaacgtacgaacgcgagtaacgcgaccgacgacgtaccgaccggtacggttactagtaacgtgtacggtagtaagaactaaacctaaacgtaaccgaaccgggacggtaccggtaacgaacctaacgtacgtacgaaccgg

SEQ ID NO: 367187 - DNA, 758 bp, Homo sapiens
  misc_feature: GZ8MTXP02GCOW2.22.11.A11.1.454.CMB.2.raw
  modified_base (304)..(304): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctattcaaaaggtgtccagtgtgaggtgcagctggtggagacgtggaggagccttgactccagccgtgggggtccctgagactctcctgtgcagcctcgtggttcaccgtcagtagcaagtacatgaggtcgtcgggtcccgaccgngggcctccggaggggaacggggcgtgggaggtggtattcttcgtaagtttatttacgtcgttaccggtagtaaccactactacctaccgcagtaccgtccggtagggacggccgtattccacctagtccctaccgagaacgaactaaacgttaccgaaagtaacgtacggtagttaactacgtttaaacaaaacttaggaaacctacggtacccgtaaagggtaacgaacccggaccccgtaaagtacccgggtaaaccgaccgggggttacccgtaagggtttaaacctttaaccggtgggtttaacggttaacgggaaaagttaactttaaaacccgttaaaaaacggttccccgaaaaccgggggtcccgggtaacccgggggtaaacccctaaaaaccccgtttaaaggtttacggaaaacccggttttacccgggtaaaaccccggggg

SEQ ID NO: 367188 - DNA, 776 bp, Homo sapiens
  misc_feature: GZ8MTXP02HSVI4.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtgggggtccctgagactctcctgtgcagcctcgtggtccaccgtcagtagcaagtacatgagcgtcggggtccgaccgagggcctaccggaagggggaacggggcgtaggggacggtgggtacttccgtagtaagttttatttacgttcggtaccggggttaaggtaaaccacgtaacttaaccgttaccgacgtacggtaccgttccgggtaggggaccgggggtacccgtacgtttacccaaccctagttcccgtacccgaaagaccgtaaaccttaaacgtttacccgaaaacggtaaaccgtacgggttattaacttccctttaaacgaaaagttcgaaaaccgtgacccgtagggaacgacggacccgaagttaccggacgtaacccgggtcgtttagttaaccgtttacgtggttagtagaacgtaaaacgttaacctaaaaacggtttcccgaaacggggtaacccccgggggttaacggggtaaacccctaaaacccgttaaaacggtttccggaaaacccgtttaccgggggtaacccgggggg

SEQ ID NO: 367189 - DNA, 640 bp, Homo sapiens
  misc_feature: GZ8MTXP02JB5SK.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctctgtgcagcctcgtggttccaccgtcagtagcaagtacagtgacgcgtcgggtcccgccgaggcctaccggaggggaacggggctgggagtggactctacgtagtttattacgtcgtacgggtacgtaaacactactacctacgcaaggtaccgtccgggtggggacggggtccctacgttacccacctactccgtaccaagaacgaactaacttaccgaaacgaaccgtacggtagttacttacgttaacaaactacgaacacgtaccctaggaacgacgaccgagtacgaccgacggtccgttagttacttagtgtgtagaacgtactaacgtaaaacttaacgaaccggtaccgggtaccggggtacccaaacccgtaaagttacgtaaccgg

SEQ ID NO: 367190 - DNA, 588 bp, Homo sapiens
  misc_feature: GZ8MTXP02IJ3L5.22.11.A11.1.454.CMB.2.raw
  modified_base (411)..(411): a, c, t, g, unknown or other
  modified_base (433)..(433): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagcgtggtggagactggaggagccttgatccagccgtgggggtccctgagactctcctgtgcagcctcgtgggttcaccgtcagtagcaagtacatgagcgtgggtccgccgaggcctcgagggaagggctgggagtggatctgagtttattatcgtcggtaggtaactatatactacgcaagaccgtccggtgggacgggcctataccacactctacaganaacaacttacaaagacgacgtntactacttacaaattagaacagaccgtgacgagaccgagacgacgacggacgtcgtaattacgtgtacggtagaacgtaactaactaaaacgttaaccgaaacggtacccggtacgggggtaacctaaacccgtaaacgtttacggtaaacccgg

SEQ ID NO: 367191 - DNA, 851 bp, Homo sapiens
  misc_feature: GZ8MTXP02FWOYR.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcacgcctcgtcgggttcaccgtcagtagcaagtacagtgagcgtcggtcccgcgaggtcctaccggaaggggaacggggcgtagggtaggtgggtatccgttacgtaagtttaatttacgttcgttccggggttacggtaaacctactaacgttaccgtaacgcgtacgtacccgttccggggttacggggaccggggtacccgtaatttcccgaaaccctacgttacccttaccccgaaaggtaaaccggtaaaccttaaaaccgttaacccgaaaacggtaaaccgtaaacccgggggttagttaacgttaacctttaaactaaaacgttaaccgaaaaccgtaaccggtaccccgttaagggaaacggaacccggtacccggtaaagtaccggtaaacccggtacccggggtaacccggtttagttaaacgtttaaccggtggtttagggtaaggtaaaacggttaaacttaaaaccgttaaaaacccgttcccggaaaacccggggtcccgggggtaaccccgggggttaaccctaaaaacccccggttaaacggtttaacccggtaaaccgggtacccggggtttaaaaccccgggggg

SEQ ID NO: 367192 - DNA, 636 bp, Homo sapiens
  misc_feature: GZ8MTXP02FTVDW.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagacgtggaggagccttgatccgagccgtgggggtccctgagactctcctgtgcagcctcgtgggttccaccgtcagtagcaagtacatgagcgtcgggtccgcgaggccgtccggaggggaacggggcgtgggaggtggatcgtacgtagtttatttacgtcgttcggtagtaacacgatacgtacgcaacgtaccgtaccggtggggacggccgtattccaccgtactcctaccagacgaacaacttaccgaaacgaacgtacggtattaacttacttacaaaagtcgaaactacgtacctagaagacgccgtaatacgaccgacggtcgttacgtacgttacgtaggtagtagaacgtaacttaacgtaaaaaccgttccgaaaacgggtcccgggtaccgggggtaacctaaacccgaaagtttaccgtaaccgg

SEQ ID NO: 367193 - DNA, 827 bp, Homo sapiens
  misc_feature: GZ8MTXP02G3746.22.11.A11.1.454.CMB.2.raw
  modified_base (253)..(253): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccgagccgtgggggtccctgagactctcctgtgcngcctcgtggtcaccgtcagtgacaagtacatgagcgtgggtccgcgaggccgtaccggaaggggaacggggctaggggtaggtagggtactcgttacgtaagttttagtttaccgtaccggttcggggttacggtaaacctaccgtaacttaacccgtacgtaccgtaacggttaaccggttacccgggggtacgggggtaccgggggacccggttactttacccgaacccttaccgttaccctacccggaaaggaaccgtaaaacctaaaccgtttaaaccccgaaaacgggtaaaccgtaacgggggtttacttaaactttacccgtttaaaacgaaaacgttacgaaaaccgacggtacccgtaagggaacgaccgggtacccgaaagttcgggaaacccggttaccgggtcccggtttaagtttaacccgtttaaacggttggggtaacgtaacgggtaaacggtaaacttaaacccgttaaaaacgttccccgggaaaacggggtccccgggggttaccgggggttaaaaccccaacccggttaaaacggtttaacgtaaaccccgggg

SEQ ID NO: 367194 - DNA, 724 bp, Homo sapiens
  misc_feature: GZ8MTXP02I5U6Z.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagtcttgggttttccttgttgctatttacaaaaggtgtccagtgtgaggtgcagcgtgggtggagacgtgggaggagtccttgactccgaggtccggtcggggggtcccctggacgtacctctccgtgtcgcagcctcgtgggttcaccgtcagtagacaagtacagtgacgtcgtcgggtccgccaggcctacccggaagggggaacggggcgtagggaggtgggtactcgtcgtaaggtttatttacgtcgttcgggtagtaaaccataacttactacgcaggtaccgtccggtaggggacggtccgtagttcccaaccgtactcctaccgaaagacgaactaaacttaccgaaacgtaaaccgtacgggtacttaaacgttaccttaaacgtaaaattacgaaactacggtaacccgttaggaacggtacggaccgtaagtacgggaacccgtacgggtacccgtttagttaactttccggtaggtaggttaggaactaaacgtaacgtaaaaacgttcccggaaacgggcccggggtaccggggaacccctaaaccggtaaaacgttcggtaaacccggg

SEQ ID NO: 367195 - DNA, 549 bp, Homo sapiens
  misc_feature: GZ8MTXP02FMN1D.22.11.A11.1.454.CMB.2.raw
  modified_base (426)..(426): a, c, t, g, unknown or other
  modified_base (429)..(429): a, c, t, g, unknown or other
  modified_base (448)..(448): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtagcaagtacatgagctgggtccgccaggctccgagggaaggggctggagtggatcgtctagtttatttatctcggtggtaacacgatactacgcagacctccggtggacggggccatttccgaccatcctaccagagacaattaccaagaacacggtntancttacaaatgaacagtccngaagacgccgagtagacgacggccgtagtattaactgtgtgagactacaaaacttccaaacgccggcggggtaccacctaaagttacgactacgtacgggg

SEQ ID NO: 367196 - DNA, 781 bp, Homo sapiens
  misc_feature: GZ8MTXP02FW8FB.22.11.A11.1.454.CMB.2.raw
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagcgtggtggagacgtgggaggagccttgactccgaggccggtggggggtccctgagacctctcctgtcgcagcctcgtgggtcaccgtcagtagcaagtacatggagcgtcgggtccgccgacggccgtaccggaagggggaacggggcgtaggggaggtgggacttcgtacgtaaggttttatttacgtccgttacgggtaaggtaaaccacgtaacgttaaccgtaccggacgtaacggtaaccgttcccggggtagggggtaaccggggtacccgtaacgtttacccgaaacccgttaacttacccgtacccgaaacggtaaacgtaaacctaaacctttaacccgaaaaacgtaaccgtaacgggttacgtttaaacttaccgtttaaactaaaacgttacgaaaccgtaacggtaccgtaacggaacggaacggaccgtaacgtaccgaaccggtacgggtaccggttagttaacgtttacggtggttacggtaggtaacgtaaactaacgtaaaaccgttccggaaacgggtacccggggtaccgggggttaacccaaacccggtaaaagttaccggtaaaccgg

SEQ ID NO: 367197 - DNA, 601 bp, Homo sapiens
  misc_feature: GZ8MTXP02HCRJZ.22.11.A11.1.454.CMB.2.raw
  modified_base (254)..(254): a, c, t, g, unknown or other
  modified_base (404)..(404): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagacgtgggaggagccttgatccgagccgtgggggtccctgagctctcctgtgcngcctcgtggttcaccgtcagtagcaagtacatgagcgtcgggtcccgccgaggtcctaccggaaggggaacgggggccttggggaagttgggactcgtacgtagtttattacgtcgtcggtagtaacactatactcgctacgacgttcgnggacgggcatcacatctcagagactaactaccaaagaacacggtatatactacaaatgaaccagacctagacgacgtccgatgaaccacggggcccttaggtaacttagtggtagtagacgtaactaacctaaaaacgttccggaaacggtaccccggggacggggtaccaaacccggtaaacttacggtaaaccgg

SEQ ID NO: 367198 - DNA, 624 bp, Homo sapiens
  misc_feature: GZ8MTXP02HK27M.22.11.A11.1.454.CMB.2.raw
  modified_base (387)..(387): a, c, t, g, unknown or other
  modified_base (396)..(396): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtgggaggagccttgactccagccggtgggggtccctgagactctcctgtgcacgtcctcgtggtcaccgtcagtagacaagtacatgagcgtcgggtccgccgacggccgtaccggaaggggaaggggcgtagggagtgggtatctacgtagtttattgtcgtcggtagtaacactatactacgcncgcgtcggnggacggccgtatccacactcaccgagacgactaactaccaaagaacgtacgtagtactacttaacaaagttacgaacgtacgtccgtaggacgacgaccgtagtacgaccgacgggtaccgtagttacttacggtgttcgtagtaagtaactaactaaaacgttaccgaacgggcccggtacggggacctaaaccgtaaacgtttccggaacgttacgggtaccgggg

SEQ ID NO: 367199 - DNA, 604 bp, Homo sapiens
  misc_feature: GZ8MTXP02FKURO.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctcgtgggttcaccgtcagtagcaagtacatgagcgtgggtcccgcagggcctccggaggggaaggggctgggagtgggatctcgtagttatttatcgtccggtagtaacactatactacgcagactcggtggacgggcctattcacctatcctaccagacgaactaatacccaaagaaccgtacggtgtaacttcttaacaaagtacgaaacagtccctaggacgacgccgaagtcgaaccgtcggcgttagtaacttacggtgtggtagaagtaactaaactaaaaccgtccgaacggggtcccggaccggggtaaccaaaccgtagtacgaacgttcgggaacccgggg

SEQ ID NO: 367200 - DNA, 595 bp, Homo sapiens
  misc_feature: GZ8MTXP02GWVS2.22.11.A11.1.454.CMB.2.raw
  modified_base (297)..(297): a, c, t, g, unknown or other
  modified_base (381)..(381): a, c, t, g, unknown or other
  modified_base (407)..(407): a, c, t, g, unknown or other
  modified_base (443)..(443): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtgggaggagccttgatccagccgtgggggtccctgagactctcctgtgcagcctcgtggtcaccgtcagtagcaagtacatgagcgtcggggtccnccgacgggcctaccggaaggggaaggggcgtgggaggtggattcgtcgtagtttattagtcgtcggtagtacacatactacgcncgctcggtggacggcctatcacatcncagacgactaagtacaagactacgtatactacttanaaatcgaactagcctggaagacgccgaatcgaacgcggtcgtagttacttacgtgttggagaacgtaactaaacgtaaaacgttacccgaaacggtcccggggtacgggtaacccaaccgtaaaagttcggtaaccgtacgggtacccgggg

SEQ ID NO: 367201 - DNA, 692 bp, Homo sapiens
  misc_feature: GZ8MTXP02HGC5K.22.11.A11.1.454.CMB.2.raw
  modified_base (340)..(340): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagcgtggtggagacgtggaggagccttgactccgagccggtggggtccctgacgactctcctgtgcagtcctcgtcggttcaccgtcagtacgacaagtcagtgacgtcgtcgggtccgccgaggccgtaccggaggggacggggctagggngtggatcgtagtacggtttattaccgtcggtcggtaagtaaccacgtaacttacgtaccgcgtaacgtaccgtccggggtacgggacgggtaccgtacttccaactacttacacgaagtaacgactaaacgtccaaagtaacccgaggtacttaaactaccttaaagaacgttacgaaacgtcgtaacccgtagaacggaccgacggttacaacggtaccgaaccccgggggtttacgttaacggttacgtttggtacggtaacgtacgtaaacgtaaccgtaaactaaaccggtaacccgggaacgggtacccgggtaccggtaacccaacccggttacgttaccggaccg

SEQ ID NO: 367202 - DNA, 754 bp, Homo sapiens
  misc_feature: GZ8MTXP02FNENZ.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtggggggtccctgagctctcctgtgcagcctcgtggttcaccgtcagtagcaagtacatgagcgtggtccgccaggcctacggagggaaggggctgggagtgggatctacgtagttatttatcgtggtagtaccatactactacgcagaccgtcggtaggacgggcctagttacacctatcctaccgaagaacgaactaaacgttaccgaaaacggtaaaccgtaacgggttacgttaaacttacctttaaacgaaaacgtttaacgaaaaccgaacgtaccccgttagggaaacggtaaccgggacccgttaacggtaccggaaaccggtaaccccggggttaccgggtttaaaccggtttaagtttaaccggttagggttacggttaacgggtaaaggttaaacgtaaacctttaaaaaaccgttaacccggttaaaaaccggggccccgggtaaaccggggggttaacccaaaaccccgtaaaacggttttacggaaaccccggttacggggtttaaacccccggggg

SEQ ID NO: 367203 - DNA, 614 bp, Homo sapiens
  misc_feature: GZ8MTXP02I22D5.22.11.A11.1.454.CMB.2.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtgggttcaccgtcagtagcaagtacatgagcgtggtccgccgaggctccgaggggaagggcgtggagtggatcgtcagtttattatcgtcggtagtaacacgatactacgacagtactccggtaggacggaccgtattccgacctactacctaccacgaacgaactaactaccgaaacgaacgacggtagtactacttaacaaatagaacgacgtaccgtagagacgaccgagtacgacgaaaacggtccgtagtacttacgtagtagtacgaagtaacgtaactaaaacgttaccgaacggtcccggtacgggggtacctaaacccgtaaacgttacgaaccgtacggtaacccggggg

SEQ ID NO: 367204 - DNA, 719 bp, Homo sapiens
  misc_feature: GZ8MTXP02FM3GB.22.11.A11.1.454.CMB.2.raw
  modified_base (244)..(244): a, c, t, g, unknown or other
  modified_base (269)..(269): a, c, t, g, unknown or other
  modified_base (273)..(273): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtggtggagacgtgggaggagccttgatccgaggccgtgggggtccctganctctcctgtgcagcctgtgggtccncgtnagtagacaagtacatgagcgtggtccgcaggctccggagggaagggctgggagtggatcacgtagtttattacgtcgtggtagtaacagaactacgtcgacagaccgtaccgtgggacgggccgtattaccgactactcgtaccgaagacgtaaacaacgttaccgaaaacgaacgtacggttagttaacttaccttaaacgtaaacgtacggtaaaaccctacgggtacccttaccgggaaggtacgggaccccgtaaagggtaccgaaacccgggtaccgggttacccgttaaggtttaaacggttaccggtttacggttaggtaaaccgggtaattaaaacggtaacccttaaaaaccgttaaccgggaaaccgggtacccgggggttaacccgggggtaacccttaaaccccgtaaaaggtttacccggttaaaacccgggg

SEQ ID NO: 367205 - DNA, 865 bp, Homo sapiens
  misc_feature: GZ8MTXP02FJFRC.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctccctgtgcagcctcgtgggttcaccgtcagtagcaagtacatgagcgtggggtcccgaccgagggcctcccgaggggaaggggctgggaggtggatcgttcgtaagtttattttactcgttaccgggtaggttaaaccacacgttaactaaccggaccacggacccttcccgggttggggaaccgggggcccgtaagtttcccaaaccctaacttcccgttacccaaaggaaacgaacctaaaacgtttaaccccgaaaacggtaaaaccgtaaacggggtttacgttaaacttacctttaaaccgtaaaaacgttaacgaaaacccgtaacgggtaccccgtttaggggaaacggtaaccgggtaaccccggaaagttaaccggggaaaacccggaaacccgggggtcccccgggtttaaacgggtttaaaacgttttaaaacccggttggggtttacgggttacgggtaaaagggttaaacctttaaaaaccgtaaaaaaccggttttaccccggaaaaaccggggtcccccgggggttaaacccgggggggttaacccctaaaacccccggtaaaaagttttacccggaaaaccgtttaacccggggtaaacccgggggg

SEQ ID NO: 367206 - DNA, 597 bp, Homo sapiens
  misc_feature: GZ8MTXP02JVDPL.22.11.A11.1.454.CMB.2.raw
  modified_base (266)..(266): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtgagactggaggagccttgatccgagccgtgggggtccctgagactctcctgtgcagcctcgtggttcaccgtnagtagcaagtacatgagcgtggtaccgccaggctccgagggaagggctggacgtggatctctagtttattgtcgtccggtagtaacactactactacgcacgaccgtcccggtaggacggccgattccaccatccgtaccgagacgtacaacgttaccgaaagaaccgacgggttatatccttaacaagtacgaacgagccctagacgacgccgaagtcgaaccgacggtaccgtagtattacgtgtagtacgagtaactacaaaacgttcccgaaacgtcccggtaccggggtacccaaccctaaacgttcgaaccgtaccggtacgggg

SEQ ID NO: 367207 - DNA, 815 bp, Homo sapiens
  misc_feature: GZ8MTXP02GBLZQ.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgtgggttccaccgtcagtagacaagtacatgagcgtcgggtcccgccgaggccgtaccggagggggaacggggtcgtggggaggtagggtactcttacgtagtttatttacgttcgttacccgggttaggtaaacctacgtaacttaccgttaaccgaccgtacggaaccgttcccgggtagggggaaccggggtcccgtaactttacccgaaccctaacgttacccgttacccgaaagggaaccgtaaactaaaacccgtttaaacccgaaaacggaaaaccgttacccggggttaagttaaacttccgtttaaaaccaaaagtacgtaaaacccgtaacggtaccccgttaagggaacgaaccggacccggtaacgtacggaaaccggtaccgggtacccggtttaaaggttacctttaacggtgggtttaggtacgggtaaacgtaacttaacgtaaaaaacggttcccgtaaaacgggccccgggggtaaccgggggttaaacccaaaaccccgttaaaggtttaccggtaaccggtttaaccgggtacccggggg

SEQ ID NO: 367208 - DNA, 710 bp, Homo sapiens
  misc_feature: GZ8MTXP02GOV14.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagtcgtgggttttccttgttgctatttacaaaaggtgtccagtgtgaggtgcagcgtggtggagacgtggaggagccttgactccgaggtccggtcgggggtccctgacgacttcgtcctgtgctacgtcctcgtcggtccaccgtcgagtagactaacgtacagtagaggtcgtccggtccgccgacggccgtacggaacggggacggggcgtggtaggtaggtacttcgtacgttaagtttaagtttacgtcgtaccggtaacgtaactacgtaactacgtaccgacgtcgtaccgtcggtacgggtcggaaaaaaaccgtcgtacctacctactccgtaccgaacgaacgtaaactaacgtaaccgaaacgtaacgtaacgttaagtacttaacttaaactaaacgtaacgaaacgtacgtaccgtaaggacgaacgaccgtacgacggtaaccggaccggtacgtagttacgttacgtggtagtagaagtacgtaaacgtaaaccgtaccgaaccggaaccgggtaccggtaaccgtaaccgtaacgtacgacgtacggtaaccgggg

SEQ ID NO: 367209 - DNA, 700 bp, Homo sapiens
  misc_feature: GZ8MTXP02HDJI3.22.11.A11.1.454.CMB.2.raw
  modified_base (524)..(524): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtggtggagacgtggaggagccttgatccagccgtgggggtcctgacgctctcctgtcgcacgtcctcgtgggtccaccgtcagtagcaagtcagtcgagtcgtcgggtccgcgacgggtccgtccggaggggaacgggcgtgggagttgggacttccgtacgtagtttatttacgtcgtaccgggtaggtaacactaacgtacgtaacggctacgggtaccgttcgggtaggggacgggtacccgtacttaccgtaccctactaccgtacccgaaagtaacgtaaactaaaccttaccgaaaacgaacgttacggtagtactacgtttaaanaaacgttagaaactacgtacccgtggaaacgacgtaccggagtcggaaaccgtccgggtaccgtttagttacgtttaccgtggtacggtagaacggtaactaaccgtaaaaccgtccgaacggggcccggtacggggtaacccaacgttaacgtcggaaaccgttcgggtaccggg

SEQ ID NO: 367210 - DNA, 620 bp, Homo sapiens
  misc_feature: GZ8MTXP02IHZCX.22.11.A11.1.454.CMB.2.raw
  modified_base (295)..(295): a, c, t, g, unknown or other
  modified_base (305)..(305): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtggttcaccgtcagtagcaagtacatgagcgtggtccnccggggggancgtaccgaggggaagggctagggagtggatctacgtagttatttactcgtaggtgtaacacattactcgacaagaccttccggtagggacgggacctacgttaccaaccactcctaccaggaacgaactaaacttaccgaaaagaaacgtacggttagtacttacctttaacaaaattacgaaactacggcctagaacgacgccgatacgacgacgggcgttagtaagttacgtgtgtagtagtaactaacgtaaaacgttaaccgaaacgacccgggtacggggtaaccaacccgtaaaagtttacgaaaccgg

SEQ ID NO: 367211 - DNA, 674 bp, Homo sapiens
  misc_feature: GZ8MTXP02GKN1Z.22.11.A11.1.454.CMB.2.raw
  modified_base (299)..(299): a, c, t, g, unknown or other
  modified_base (541)..(541): a, c, t, g, unknown or other
  modified_base (597)..(597): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggtagttttggctgagtcgttgggttttccttgttgcttatttacgaaaaggtgtccagtgtgaggtgcagcgtggtggagacgtggaggagtccttgactccgaggtccggttcgggggtccctaggacgtaccttcctccgtgtcgcgacgtcctcgtcggtccaccgtnagtagactaagtacagtgacgcgtcggccgcgacgtccgtacggaggggacggcgtgggagtgactcgtagtagtttattacgtcgtacgtagtacactactacgcgcacgtaccgtcggtaggacgggtcctacttacccactaccgtctaacccgaaggtaaccctaaacttaaccgttaaaccgaaacggtaaacccgtaggtttacgtaacttaccgttaaacaaaggtaccgaaacncgtaccgaggacgtacgacccgtagtaccggaccgtacggtcgttattattacggnggtacgtagaacgttaacaaccgttaaacgccgacgggtaccggtaccggtaccaaacctaacggtcgtaaacccgg

SEQ ID NO: 367212 - DNA, 753 bp, Homo sapiens
  misc_feature: GZ8MTXP02I0S32.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagcgtggtggagacgtggaggagccttgatccgaggccgtcgggggtcctgacgactctcctgtgcacgcctcgtcggttccaccgtcagtagacaagtacagtgacgcgtcgggtcccgccgacggccgtaccggaggggaacggggtcgtgggtaggtggtacttcctacgtaagttttattacgtcgttaccgggtacgtaaccactactacgtaccgcgtaggtccgttccggggtacggggaccggtaccgtacttaccgaccctagtccctaccgagaaacactaactaacaacgaacgtacggtactactcttaaacaaacgttagaaaccgtacgaccgttagggaaaccgtaccggtacgtaagtacgggaaaacccggtccgggttaccggttaagttaaccgttttaacggtggtttaacggtaacgtaaacggttaaacttaaaaccgtaaaaaccggtttaccggaaaaccggggtcccgggggtaccggggtaaaaccctaaaaccggtaaaaccgttttcggaaaccccggttttaacggggacccggggg

SEQ ID NO: 367213 - DNA, 640 bp, Homo sapiens
  misc_feature: GZ8MTXP02FFJEF.22.11.A11.1.454.CMB.2.raw
  modified_base (234)..(234): a, c, t, g, unknown or other
  modified_base (299)..(299): a, c, t, g, unknown or other
  modified_base (379)..(379): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtcccngagactctcctgtgcagcctcgtgggttccacgtcagtagcaagtacatgacgcgtgggtccccncgaggcctacggaggggaaggggctgggagtggatctacgtagttatttagtcgtaccggtagtaaacactataccgacncagactcggtagggacgggcctagtccacgactctaccaagacgaactaaacttaccgaaagaaaccgtacggtagtacttacttaaaccaaagtaacgaaaccgaacgcccgtaggaagacgacccgtagtacggaccgaaccgggtaccgtagtaacgttacgtggtgtacgaagtaactaaactaaaactcccgaaacggcccggggtacgggtaaccgtaaacccgaaagttacggtaaccgtacggtaaccggggg

SEQ ID NO: 367214 - DNA, 729 bp, Homo sapiens
  misc_feature: GZ8MTXP02JV4RN.22.11.A11.1.454.CMB.2.raw
  modified_base (333)..(333): a, c, t, g, unknown or other
  modified_base (352)..(352): a, c, t, g, unknown or other
  modified_base (520)..(520): a, c, t, g, unknown or other
  modified_base (556)..(556): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggtagttttggctgagtcgttgggttttccttgttgcttatttacgaaaaggtgtccagtgtggaggtgcagcgtggtggagacgtgggaggagtccttgactcccgaggtcccggttcggggggtccctaggacggtaccttccgttccgtggttcgaccacgtcccttcggttcgggttaccaccgttcgagtacgacaagtanagtgacgtcgtcgggtccnccgaggcccgtaacggaggggtaacggcgtagggtacgtggtacttgtacgttaggtttatttaccgtcggttacggtaaacgtaaccaacgtaccttaacgaccgtacgtaacggtaccgtacggggtcggaacgggacctaatccccaagtcctacccacgggaanacgtaaaccgtacttaaccgaaaagtcgtacggttnaaactttactaacgaaaacgttgaacgtaccgtaccgaggaaaccgcgttacgaacgttcggaacccgttacgggtaccgtttataaaggtttcagttaccggataaacgtaacttaaccgtaaacgtccgaccgggttacgggcgtaaaaccctacgacgttagtaccccgg

SEQ ID NO: 367215 - DNA, 666 bp, Homo sapiens
  misc_feature: GZ8MTXP02JY5EP.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctcgtggttccaccgtcagtagcaagtacatgacgcgtgggccgccaggcctaccggaggggaaggggctggagtgggatctgtagtttatttatcgttaccgggtgtaaccactaactactacggcacggaccttccgggtgggacgggtacccgtatttcccgaaaccctactacctacccgagaacggaacctaaacgttacccgaaagtaaaccgtaacggggttacttacttacctttaacaaaacgttacgaaacgacgtaccgttaaggaggaccgacccgaagtacgaacgtaccggtccgtaggtatttacgtgtggtagaactataccgtaaaacttcccggaaacggcccgggtacgggggtaacccaacccgtaaagttacggtaaccgtacggtaccggggg

SEQ ID NO: 367216 - DNA, 687 bp, Homo sapiens
  misc_feature: GZ8MTXP02GES1R.22.11.A11.1.454.CMB.2.raw
  modified_base (534)..(534): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtgggaggacgccttagactccgagccggtcggggggtccctgacgtactctcctgtcgcacgcctcgtcgggtcaccgtcagtacgactaagtacagtgagcgtcggccgcgaggcgtccgaggggagggcgtgggagtggatctacgtagtttatttacctcgtacggtagtaaccactagttaacctcgacacggtaccgttccggaggggacgggtacctagttacccaacctacgtaccgtacccgaaggtaaaccgaactaaaccgtttaaccgaaaacgtaaccgtacgggtacttaaacttacgtaacaaacgttacgaaacncgtaccgtagacgacgtaccgtatcgaaccgacggtccgtagttaacgttacgtaggtagttagaaacgtaacttaaacgaaaaccgttcccggaaaacggtcccggggtaacggggtaaccctaaaacccgtaacggttacggtaaacccgg

SEQ ID NO: 367217 - DNA, 591 bp, Homo sapiens
  misc_feature: GZ8MTXP02H0M2Q.22.11.A11.1.454.CMB.2.raw
  modified_base (320)..(320): a, c, t, g, unknown or other
  modified_base (330)..(330): a, c, t, g, unknown or other
  modified_base (438)..(438): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaaggtgtccagtgtgaggtgcagctggtggagactggagagccttgatccagcctgggggtccctgagactctcctgtgcagcctcgtggttcaccgtcagtagcaagtacatgagctggtccgcaggctcaaggggaggctggagtggatcncagttattanctcggtgtaaacagatactacgcagactccgtggagggccgattcaaccactctccagagacaaattcaaagaacacggtagtactcttataaagtgaaacagacccngaagagacccgaatacgaacgacggtaccgtaggttaacgttaacctggtttagagaaacgtaattaacctaaaaaaaggtttcccaaaagaaccccgggacgggggttaccaaaacccgtaaaaacttacgtaacgtaaccggtaacggggg

SEQ ID NO: 367218 - DNA, 632 bp, Homo sapiens
  misc_feature: GZ8MTXP02GI6XI.22.11.A11.1.454.CMB.2.raw
  modified_base (500)..(500): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttacaaaaggtgtccagtgtgaggtgcagctggtggagtacgtggaggagccttgatccaggccgtgggggtcctgagactctccgtgtgcagtccgtcgtagggttcaccgtcagtagccaagtacatgagtcgtggtccgcccgaggcctaccggaggggaagggcgtgggaagtggatctacgtagtttatttatcgtacgggtagtacacgacttacgtacgacacgtaccgtcggtgggacgggtaccgtaactttccaaccctagtccctaccgaagacgaactaaacgttcccaaagtaacacgggtatactattacaaatagaacgtcganacggaagagaccggatcggaaacgccggtaccgtagttacgttactaggtcgtaagaagtactaacgtaaactcgtaacggaaccggtccggggtaacacccgtaaagtttcgaccgttacggtacccgggg

SEQ ID NO: 367219 - DNA, 699 bp, Homo sapiens
  misc_feature: GZ8MTXP02FUEED.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgactccaggccgtgggggtccctgagactctcctgtgcacgcctcgtggttcaccgtcagtagacaagtacagtgagtcgtcgggtcccgcgaggccgtaccggaggggaacggggtcgtgggaggtacgggtactcgttacgttaagtttatttacgttcggtaccgggttacgtaaacctaactaacttaccgttaacggactacggtacccgttccggggtacgggaccggggtccgtaactttaccacctacgtccgtacccgaagaacgtaactaaacgttaccgaaagtaaaccgtacggttataacgttacttaaaccgaaagttacgaaacgtacgaccgttaaggacgacgacgtagtacgacgacggtcgttagtacttacgtggtacgtagaaacgtacttaacgtaaaacgttccggaaaacggtccgggtacgggtaaccaaaccgtaagtacgaacgttacggtaaccgggg

SEQ ID NO: 367220 - DNA, 629 bp, Homo sapiens
  misc_feature: GZ8MTXP02IWO1S.22.11.A11.1.454.CMB.2.raw
  modified_base (272)..(272): a, c, t, g, unknown or other
  modified_base (299)..(299): a, c, t, g, unknown or other
  modified_base (307)..(307): a, c, t, g, unknown or other
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagacgtgggaggagtccttgactccgagccggtcgggggtcctagacgactctcctgtgcagcctgtcggtcaccgtnagtagacaagtacatgagcgtggcccncgaggtcncgaaggggaggcgtaggagtggacttctcgtagttttattagtcgtcggtacgtaacacacgtactacggcaggtaccgtcggtaggggacgccgtattacacctactcaccgagaacgaactaactaccaaagaccgtaggtatactcttaacaaagtagaaactcggccagaaacgcgttacgagcgaaacgccggtaacgtttagttaacgttacggtgtaggtacgtaaactaaacgtaaactaaaaccgttaaaccgtaaccggtaaccgggtaccgggtaaccgtaaaccgtaaacgtaacgtacgtacggtacgg

SEQ ID NO: 367221 - DNA, 845 bp, Homo sapiens
  misc_feature: GZ8MTXP02FFY2G.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttcctgttgctatttacaaaggtgtccagtgtgaggtgcagctggtggagacgtggaggagccttgatccaggtccggtcgggggtccctgacgtacctctcctgtcgcacgtctcgttcggggttcaccggtcagtaacgcgaaatacagtgagtcgtcgggtccgccgaggccgtaccggaaggggaacggggtcgtggggtaaggtgggtacgttccgttacgttaagtttaacgttttacttacggttcccggggttaagggtaaacctaaactaaccgttaacgtaacccggagtaccgtaccggtaccggggtaggggtaccggggtaccctaatttaccgaaaccctactaccgttaacccgagaaacgtaaccgtaaacgtttaacccgaaaaggtaaaccgtaaccggttaggttaaaccgttacttaaactaaaacgtaacggaaaaccaacggtaccttacgggaaacggacgtacccgggtaacgttaacggaaccggtaaccgggtaccgttaacggttaacgtttaaaccggttggttacgggtaaaggtaaacggtaaacttaaaccgttaaaaaaccggttcccggttaaaaccgggaacccgggggtaacccgggggtaaacccgtaaaacccccggttaaagttaaaccggtaacccggttacgggtaaacccccggggg

SEQ ID NO: 367222 - DNA, 721 bp, Homo sapiens
  misc_feature: GZ8MTXP02I3IB7.22.11.A11.1.454.CMB.2.raw
  modified_base (637)..(637): a, c, t, g, unknown or other
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagctggtggagacgtgggaggagccttgactccgaggtccggtcgggggtccctgacgtacctctcctgtgcacgtcctcgtcggtcacgtcagtagactaagtacagtggacgtcgtacgggtccgaccgacggccgtacggaggggaaggggtcgtagggaggtggtactctacgtaagtttattactcgttaccgggtacggtaaaccacgtaacttacgtaccgacgtacgtccgtaccggtaggggaccgggtaccgtactttccgaaccctatccctaccgaagaaccgtaaacccttaacgttaaccgaaacgtaacgttacgggttactaacttaccttaaacgaaattacggaaaccacgggtaccctaagggaacgaccggtacctagtaccgaacgtcggtaccgttagtaacgtttacgtggttagaggtaaactnttaaaaccgaaacgttccgaaacggggtcccgggtacgggtaaccctaaaccgttaaaggtccgaccgttacgggaacccgggg

SEQ ID NO: 367223 - DNA, 746 bp, Homo sapiens
  misc_feature: GZ8MTXP02JCDG7.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagctggtggagacgtgggaggagccgttgatccgaggtccggtcggggggtccctggacgtacttcctccgtgtgcacgcctcgtcggtccacgtcagtacgacaagacagtgagcgtcgggtcccgccgacggtccgtaccggaaggggaacggggcgtaggggtaggtcgggtattcttacgtagtttatttacgttcgtacgggttacgtaaactactaactactacgacgtacgaccggttcgggacggggacggtaccgttacgttaccaacccgtagtccctaaccgaagaacgtaactaacgttaccgaaacgtaacggtacggttataaccttacttaaacgaaagtacgaaacgtacgacctaggaaccgacggacgtaacgtccggggaaactccggggttaccgtagttaaccgttacgttgggtacttaaagggaacctaacgttaaaccgaaaaccgtttccggaaaaccgggtcccgggggtaacccgggtaaaccctaaacccggtaaagtttccgggaaacgttaccggggtaacccgggg

SEQ ID NO: 367224 - DNA, 646 bp, Homo sapiens
  misc_feature: GZ8MTXP02JEE7Q.22.11.A11.1.454.CMB.2.raw
  modified_base (366)..(366): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgctatttcaaaggtgtccagtgtgaggtgcagctggtggagacgtggaggagccttgatccagccgtgggggtccctgagactctctgtgcagcctgtggttccacgtcagtagacaagtacatgagcgtcggtccgcgacggctcggaggggagggcgtgggagtggactcgtatagttatttcgtcgtcggtagtaacactatacncgcacgaccgtccggagggacgggtacctcttaccgacctatcctaccgaagacgtaactaacttaaccgaaacgtaacgtacggtcgttaaacttaccgttaaacgaaacgttacgaacgacggtaccgtagtaacgacggaccgtaagttaccgaaccggtacggtaccgtacgttacgttacgttagtacggtagtaacgtaactaaccgtaaaacgtccgtaaacggtacccggggtacgggggtaaccctaacccgtaaacgttacgtaaaccgg

SEQ ID NO: 367225 - DNA, 757 bp, Homo sapiens
  misc_feature: GZ8MTXP02G78MU.22.11.A11.1.454.CMB.2.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagctggtggagacgtgggaggagccttgactccgaggtcccggtcgggggtccctggacgtaccttcctccgtggtgcgacgtccgttcggtcgggttccaccgtcaaggtacgacgtaagtacagtgacgtcggtcgggtccgccgacggccgtaccgggaaggggtaacggggcgtggggtagtcggtacttacgtcgttaagtttactttaacgtccgttaaccggttaacggtaaactacgtaacgtttaccgacgaccgtacgtaccgtaccgggtagggaccgggacctacgtacccaaaccgtctcccacgtaagaaccaactaacttaccgaaaggtaactcggttactactaccttaaagaaattcgaaaacgtcgtaccgaaggacgacgtacctaaggtaccgaccgtccgggtacgttattaacgtttacgtcggttagtaaacggtaaataacgtaaaacctttaaaaccggtcggaaaccgggcccgggggtaccggttaaaaccctaaacccggttaaagtttcccgaaccggggtttaacggaccccggggg

SEQ ID NO: 367226 - DNA, 698 bp, Homo sapiens
  misc_feature: GZ8MTXP02GWNOC.22.11.A11.1.454.CMB.2.raw
  modified_base (252)..(252): a, c, t, g, unknown or other
tcagacatacgcgtcacgaccggtgctcgatttagctacgactgcaggggctgggagaggagcccagcactgggattccgaggtgtttccattcggtgatcagcactgaacacagaggactcaccatggagttttggctgagctgggttttccttgttgcttatttcaaaaggtgtccagtgtgaggtgcagctgggtggagacgtggaggagccttgatccaggccgtgggggtccctgagactctcctgngcagctcgtcggtcaccgtcagtagacaatacatagagcgtcggtccgccgacggcctaccggaggggaaggggtcgtagggtaggtgggactcttacgtagttttacgtttacgttcgttaggggtacgtaaacactaacttacgtaccggacaaggtaccgtaccggtaggggacggggtaccgtaacgtttacccgaacctaacgttccctaaccgaagtaacaaactaaacgttaaccaaaacggtaaaccgtaccgtagtttaaacttaccgttaaactaaaacgttacgaaaacgtacgtaccctaagggaaaggaccgtacgaagtacggaacgacgggtcgtagttacttacgtgtagtaagtacgtaacgtaactaaaaccgttcgaaaacgggtccggaccggggttacaaaaccgttaacttacggtaaacccgg

SEQ ID NO: 367227 - DNA, 656 bp, Homo sapiens
  misc_feature: GZ8MTXP01CUUSK.8.21.B10.1.454.CMB.2.raw
  modified_base (232)..(232): a, c, t, g, unknown or other
  modified_base (310)..(310): a, c, t, g, unknown or other
tcagctcgcgtgtccacgaccggtgctcgatttagtgtcgtcgcaagagaggagggggggagtcagtctcagtcaggacacagcatggacatgagggtccccgctcagctcctggggctcctgctcctctggctccgaggtgccagttgtgacatccagttcgacccagtcctccctcctctctgtctgcttcgtggtgggacgacagccgtcaccatcacgttggccgggnagtcagtccaattaacaaattatttaaatgtaatacaaacaaaaccgagggaaacaccctaaatacctgtactatacngcactccactttagactaaaggtcgggtacccatacgaaggttcaggtggactaggtggtagtttgggacttagtttacactctacaacaatcagctagtctacgtaactagaagttatttacgaactaactttactactagtacaaactagtaacttaaacgaaattaacgtaaccggtaagggttaccggtttacgggaacgaaacggggtaacctaaagggggtagtaaaggtaactaaaccggaaaacggtaacgttgggttacgggtaccttacggacctaacccttagttccttacgttccttacctaacgtttccccttccccgactaacttccgtaag

SEQ ID NO: 367228 - DNA, 713 bp, Homo sapiens
  misc_feature: GZ8MTXP01BMO6Y.8.21.B10.1.454.CMB.2.raw
  modified_base (199)..(199): a, c, t, g, unknown or other
  modified_base (224)..(224): a, c, t, g, unknown or other
tcagctcgcgtgtccacgaccggtgctcgatttagtgtcgtcgcaagagaggaggggggagtcagtctcagtcaggacacagcatggacatgagggtccccgctcagctcctggggctcctgctcctctggctccgaggtgccagttgtgacatccagttgacccagtctccctcctctctgtctgcttctggtggganacagcgtcaccatcacttggccggnagtcagtccattaacaattattaatggtatacaaacaaaaccagggaacaccctaaatacctaggtactatactgctactcctactttgacgtaaacggtcgggggtacccagtacgtaaaggttcgaaggtcggctacggttgggtagtttggggacttacggttttacacgttctactaactaatacagtactaacgtcctacggtaaaccgtaggtaaacggttacttttacggacctttaaacgtttaaccttaacgtacggttaaccgaaaccgtaagttaaacctttaaacaaacgttaacgttaacccgggtaacgggtaaccgggtttacgggtaaccgaaacggggtaaccgaaacggggttagggaaacgtaacgttaacgaaaaccggtaacgttggttacgggtaacttcggtaaaccaccgttagttcgttacgttcttacaactttcccgttacccgccttaagttcccgtaagg

SEQ ID NO: 367229 - DNA, 640 bp, Homo sapiens
  misc_feature: GZ8MTXP01DKHWM.8.21.B10.1.454.CMB.2.raw
  modified_base (199)..(199): a, c, t, g, unknown or other
  modified_base (224)..(224): a, c, t, g, unknown or other
  modified_base (388)..(388): a, c, t, g, unknown or other
tcagctcgcgtgtccacgaccggtgctcgatttagtgtcgtcgcaagagaggaggggggagtcagtctcagtcaggacacagcatggacatgagggtccccgctcagctcctggggctcctgctctctggctccgaggtgccagttgtgacatccagttgacccagtcctccctctctctgtctgcttcgtggtggganacagccgtcaccatcacttgccggnagtcagtctaataacaatatttaatgtatacaaacaaacaggaacaccctaaatacctaggtctaatactgactactcctaacgtttacgacgtaaaggtcggggttacccatcgaaggttcagtgactagtggtatttgggactagtttcaactcgtactaanatcaagcgtaacgtcctacgaactacgtaagtattttcgactaaactttactactagtacaaactagtaaacttaacaaacggtaacgtaaccggtaacgggtaaccgtttacgggtaacggaaacggggtaaccgtaaagggttacggaagtaacgtaacgaaaccggtaactggttacggacgttcgtaccgacttacgttcttacggttcttacgtaacgttcccttacccgacttaacttcgtaacgg

SEQ ID NO: 367230 - DNA, 745 bp, Homo sapiens
  misc_feature: GZ8MTXP02JPUSV.8.21.B10.1.454.CMB.2.raw
  modified_base (199)..(199): a, c, t, g, unknown or other
tcagctcgcgtgtccacgaccggtgctcgatttagtgtcgtcgcaagagaggggggagtcagtctcagtcaggacacagcatggacatgagggtccccgctcagctcctggggctcctgctcctctggctccgaggtgccagttgtgacatccagttcgacccagtcctccctcctctctgtctgtcttctggtggganacagcgtcaccatcacttcggccgggcagtcagtccaattaacaacttatttaaatgtaatacaaacaaaaccgaggaaacaccctaaatcctgtactatactgactactcctactttcgacgtaaacggttcggggtacccctaagtaccggtaaggtttccgaaggttacgggaccgtagggttaggggttaacgttttacggggaacctttacggtttttaccaacccgttaccttaccaaaccgtaaacttccgacgggtactaacggttaccgtaacccggtaaaacccgtaaaggggtttaacttttacggaaacctttaaaaccgttacccttaacgtacgtaacctaaacgtaacgttaacctttaaacaaacgttaacgtaaccggaacgggttaccggtttacgggaaccgaaacggggaaccgtaaggggtacggaaagtaactaacggaaaacgtacgttaggtacggactacgacctacgtacttctcgttaccttactaaccgtcccttcccgactatccgtaggaaccgcg

SEQ ID NO: 367231 - DNA, 768 bp, Homo sapiens
  misc_feature: GZ8MTXP02HCRKL.8.21.B10.1.454.CMB.2.raw
  modified_base (185)..(185): a, c, t, g, unknown or other
  modified_base (425)..(425): a, c, t, g, unknown or other
tcagctcgcgtgtccacgaccggtgctcgatttagtgtcgtcgcaagaggagaggggggagtcagtctcagtcaggacacagcatggacatgagggtccccgctcagctcctggggctcctgctcctctggctccgaggtgccagttgtgacatccagttgacccagtctccctctctctgtccntctgtggaggacacgcgtctacactctactcgtcgggccggagtactacgtactacttaactaaactaatttaaatttaggtactaacaaacaaaaaccgaaggaaacgacccctaaactaactcggtctactatagcactacctaccttagtacgaaaggtacggggtcccgtaactacgttaacggtacgtagtagggctagtacggggttagttgggtaacgtaacttttctaaccncttccaactaaaggtacctacgaccgtacggtccttaacccgtaaacccgtagttaaaaggtaactttttcggtaaccaaacctttaaaacttcgtacgttaaccaaaactaaaacggttactttaaaactaaacttaaacgtaaccgggttacgggaacggttttacccgggtaacggaaaaccggggaaaccgtaacgggggttaaggggtaaacgtaaacgttaaacgtaaaaccgggtaacggttacgggtccggtacgtaacggacctaaaccgtacttacgttcgtttaacctaacgttaccgttccccgttaccgtacctacgtacgtacggaacg

SEQ ID NO: 367232 - DNA, 507 bp, Homo sapiens
  misc_feature: GZ8MTXP01EIN9V.13.9.A09.1.454.CMB.2.raw
  modified_base (190)..(190): a, c, t, g, unknown or other
  modified_base (355)..(355): a, c, t, g, unknown or other
  modified_base (454)..(454): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtcctactcatctttacaaaactaccaggcgccctcgtgggggtccctgagcgattctccccggctcgcctctggaaacacngtcactctgaccatcacgcgggacccagcctattgatgaggctgtcttactctgtcgaggggcgtgggacaagagcgtgcgtggttcgggcggaggccngtctgaccgtcttaggcagcccgaggctgcaaccgtcgcactcttcgttcccc

SEQ ID NO: 367233 - DNA, 565 bp, Homo sapiens
  misc_feature: GZ8MTXP01B1QKT.13.9.A09.1.454.CMB.2.raw
  modified_base (360)..(360): a, c, t, g, unknown or other
  modified_base (373)..(373): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttacaaaatccaggccggccctcgtgggggtccctgagcgattccgtccccggctccgcctctgggaaaccacngtcactctgaccntcgacgcgggacccaggcctattgatgaggctgtctacttctgtcgaggggcgtggggacaacgagcgtgcgtggtcgggcgggacgggaccctaggtccgtcggttacccggttcgtttaagggtccaggccccgaagggccctcggcccccccgttgggtcccacttcccgttccgttcccccggtcccc

SEQ ID NO: 367234 - DNA, 550 bp, Homo sapiens
  misc_feature: GZ8MTXP01ETBY5.13.9.A09.1.454.CMB.2.raw
  modified_base (369)..(369): a, c, t, g, unknown or other
  modified_base (475)..(475): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccacgccccctgtcctactcatctttacaaaatccaggccggccctcgtcgggggtccctgacgcgtacttccgtccccggccttccgcctcgtcgggaaaacacngtcactctgaccatcacgccgggaccagcctattgattcgaggtctagtctacttctgtcagggggcgtgggaacaacgagcgtgcgttggtcgggcggaggccgngtcgtcgaccgttcgttaggcacgacccgttagggcctccgccccgtcggtcacgttctccgtttcccaaccccg

SEQ ID NO: 367235 - DNA, 646 bp, Homo sapiens
  misc_feature: GZ8MTXP01EF5K1.13.9.A09.1.454.CMB.2.raw
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccacgccccctgtcctactcatctttacaaaatccaggccggccctcgtcgggggtccctgacgcgacttccgtccccggctccgcctcgtacggggaaaaccacgtcgtcctacctctaccgaacctacgtaccgaccgggacccgggacccacgtaccgttagttacggtagtacgggacggttcttcgttaccttaccgttcgttacggtacggtacgggggtcgggttacggggaaaccaaacggcggtcggtcggtcgttcggggtccgggacggggtacggccgtaggtccgtacggttccgttacgttacgacgaccgaccgaggttccctccggtccccgtcgtacctccgttccgttcccgttcccctaacccg

SEQ ID NO: 367236 - DNA, 540 bp, Homo sapiens
  misc_feature: GZ8MTXP01EFMLO.13.9.A09.1.454.CMB.2.raw
  modified_base (190)..(190): a, c, t, g, unknown or other
  modified_base (368)..(368): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggtctggtatcagcagaagcaggccagccccctgtcctactcatctttacaaaatccaggccgccctcgtcgggggtccctgacgcgacttccgtcccccggccttccgccctcgtacgggaaaaccacgngtccactctcgacccatcgacgccgggacccagcctatgatgagtctgtctacttctagtcgaggggcgtgggacaacgagcgtgcgtggtcggcgggaggccagtctcggaccgtcttagggcacgcccgaggcctcggcccctcggtccaccgttctccgttcccgcccg

SEQ ID NO: 367237 - DNA, 562 bp, Homo sapiens
  misc_feature: GZ8MTXP01C70BG.13.9.A09.1.454.CMB.2.raw
  modified_base (358)..(358): a, c, t, g, unknown or other
  modified_base (429)..(429): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttacaaaatccaggcgccctgtcggggtccctgacgcgattcctccccggctccgcctcgtagggaaacacngtcactctgaccatcagcggaccagcctatgatgaggctgtctacttctgtcgaggggcgtgggacaacgngcgtgcgtggtcggcgggacggacctggtcgtcggttaccgttcgttacggtccgacggttacccgacggttcccgtcccggtcccccgttcggtaccctaccgttcccgttcccgtttcccccgtaaccccg

SEQ ID NO: 367238 - DNA, 547 bp, Homo sapiens
  misc_feature: GZ8MTXP01ALVUX.13.9.A09.1.454.CMB.2.raw
  modified_base (190)..(190): a, c, t, g, unknown or other
  modified_base (364)..(364): a, c, t, g, unknown or other
  modified_base (447)..(447): a, c, t, g, unknown or other
  modified_base (470)..(470): a, c, t, g, unknown or other
  modified_base (492)..(492): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactagagtatggttctgtatcagcagaaggcaggccacgccccctgtcctactcatctttacaaaactccaggccgcccctgtcgggggtccctgacgcgtattccgtcccccggcctccgcctcgtggaaaaccacgngtccactctacgaccatcaacggcccgggacccagcctattgactgagctgtcttactctgtcgaggggcgtagggacaacgngcgtgcgtggtcggcggaggccngtctggaccgttcttaggtccncgcccgagggccctcggccccctggttccaccgttcctccgttcccctaaccccg

SEQ ID NO: 367239 - DNA, 548 bp, Homo sapiens
  misc_feature: GZ8MTXP01C2Q66.13.9.A09.1.454.CMB.2.raw
  modified_base (364)..(364): a, c, t, g, unknown or other
  modified_base (503)..(503): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtatgactaacgagtatggttcctggtatcagcagaaggcaggccagccccctgtcctactcatctttacaaaatccaggccgccctcgtcggggccctgacgcgattccgtccccggctccgcctcgtacggggtaaaaccacngttccacttcgtacgaccatccgacggccgggacccagccctagttgatgacggtctgtctacttctgtcaggggcgtggggacaacgagcgtgcgtggttcggcgggtaggccgaggtctggaccgttgttacggtcncggcccgaggctccgccccgtggcctcttcctcgttccccgtccc

SEQ ID NO: 367240 - DNA, 573 bp, Homo sapiens
  misc_feature: GZ8MTXP01BGHZF.13.9.A09.1.454.CMB.2.raw
  modified_base (190)..(190): a, c, t, g, unknown or other
  modified_base (363)..(363): a, c, t, g, unknown or other
  modified_base (365)..(365): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtccctactcatcctttacaaaatcccaggccgccctcgtcgggggtccctggacgcgattccgtccccggcctcgcctcgtgggaaacncngtcactctcgaccatcgagccggaccagcctatgatgaggtctgtctacttctgtcgaggggcgtgggacacgagcgtgcgtaggtcgggcgggacgggccgaggtcgtacggttaccggttcgttacggtccgaacggccccgaaggttcccgtccggtccccccgttcgggtccctacccgttccgttccgtttcccccttccccg

SEQ ID NO: 367241 - DNA, 538 bp, Homo sapiens
  misc_feature: GZ8MTXP01D5ZED.13.9.A09.1.454.CMB.2.raw
  modified_base (190)..(190): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaagagtatggttctggtatcagcagaaggcaggccacgccccctgtcctactcattctttacaaaatccaggcgccctcgtcggggtccctgacgcgattcctccccggcctccgcctcgtacgggaaacacgcgtcactctacgaccagtcgacgccgggaccagcctattgatgaggctgtctactctagtcgaggggcgtagggacaagagcgtgcgtggtcggcggagggccaggtcgtcgaccgttcttaggccacgaccgaggcctaacgccccgtggtcctacttctccgttcccctaacccg

SEQ ID NO: 367242 - DNA, 579 bp, Homo sapiens
  misc_feature: GZ8MTXP01D55EK.13.9.A09.1.454.CMB.2.raw
  modified_base (190)..(190): a, c, t, g, unknown or other
  modified_base (333)..(333): a, c, t, g, unknown or other
  modified_base (376)..(376): a, c, t, g, unknown or other
  modified_base (385)..(385): a, c, t, g, unknown or other
  modified_base (465)..(465): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctctatgagttgactcagccaccctcatcgtccgtcgtcccccgganagacagcctacatccacctgctcgtggagtatgtattgaactaacgtagtattggtctggtatcagcagaaggcacggccacgcccctgtcctactctattctttaacaaaactaccgaggccgtcccgtcgtcggggtcccngacgcgtcttccgtccccggcctccgcctcgtacggaaacacngtccactcncgaacctagtcgacgccggaccacgtcctatgatggacgtctgtcttacttctcgtcgagggggtcggtaggaacaacgngcgtgtcgtggtcgggcgggacggccaggtccgtcgttaccggttcgttacggcgtacgcccgacggttcctccgccccgtcggtccctcgttccgttcccgttccccgtcccg

SEQ ID NO: 367243 - DNA, 580 bp, Homo sapiens
  misc_feature: GZ8MTXP01D8J2D.13.9.A09.1.454.CMB.2.raw
  modified_base (191)..(191): a, c, t, g, unknown or other
  modified_base (218)..(218): a, c, t, g, unknown or other
  modified_base (371)..(371): a, c, t, g, unknown or other
  modified_base (450)..(450): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtcccgtgtcccccgganagacagcctacatcacctgctctgganatgtattgactaacgagtatggttcctggtatcagcagaaggcaggccagccccctgtcctactcattctttacaaaactaccaggccggtccctcgtgggggtcccctgacgcgattccgtccccggcctccgcctcgtcgggaaaaccacngtcactctcgaccatcagccgggacccagcctattgatggagtctgtctacttcgtgtcgagggggcgtgggacaacgngcgtgcgttcggtcgggcgggtagggacctaggtccgtcggttacccgttcgtttacgggaccacggccccgaagggttccctaaccggtcccccgtcggtcccaccgttccttccggttccccgtcccc

SEQ ID NO: 367244 - DNA, 594 bp, Homo sapiens
  misc_feature: GZ8MTXP01BBYZA.13.9.A09.1.454.CMB.2.raw
  modified_base (219)..(219): a, c, t, g, unknown or other
  modified_base (461)..(461): a, c, t, g, unknown or other
  modified_base (565)..(565): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtcgtccccccggacagacagcctacatcacctgctctgganatgtattgactaacgagtatggttcctggtatcagcagaaggcaggccacgccccctgtccctactcactctttacaaaactccgaggccgccctcgtcgggggtcccctggacgcgtattccgtccccgggcctccgcctcgtcgggaaaccacaagtccactctcgaccatcgacgccgggacccagcctattgactggaggtctgtcttacttcgtgtcgaggggcgtagggacaacgngcgtgcgtcggtcgggcgggacgggcctaggtccgtcggttaccggttcgttacgggtccacgggttaccccgacggccctcccggcccccgttcgggtacccncccttccgttcccgttccccctaaccccg

SEQ ID NO: 367245 - DNA, 604 bp, Homo sapiens
  misc_feature: GZ8MTXP01CJ5F4.13.9.A09.1.454.CMB.2.raw
  modified_base (191)..(191): a, c, t, g, unknown or other
  modified_base (460)..(460): a, c, t, g, unknown or other
  modified_base (490)..(490): a, c, t, g, unknown or other
  modified_base (547)..(547): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaagagtatggtcctggtatcagcagaaggcaggccacgccccctgtcctactcatctttacaaaataccgaggccggcccctcgtcgggggtccctgacgcgtacttccgtcccccggcctccgtcctcgtacggggaaaaacccacaagtccaactcctacggacccatccgaacgggccgggaaccccaggccctagttcggattaggacggcttcggtcttaccttcngttccgagggggtcggtggggaaccaacgngtcggtgcgttgggttcggcgggacgggaccaggtctcggaccggttcgttaggtcncgcccgttaggcccttccgcccccgtggtctaccgttcgttcccgttccccgtcccg

SEQ ID NO: 367246 - DNA, 591 bp, Homo sapiens
  misc_feature: GZ8MTXP01B980S.13.9.A09.1.454.CMB.2.raw
  modified_base (384)..(384): a, c, t, g, unknown or other
  modified_base (465)..(465): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtccccccggacagacagcctacatcacctgctctggagatgtattgactaacgagtatggttctggtatcagcaggaaggcaggccacgccccctgtccctactctacttctttaacaaaactacccgagggccggtccccgtcgtcgggggtccctggacgcgtacttccgtccccggctccgcctcgtcgggaaaccacngtccactctagaccatcgacgccggacccagctatgatgacggtctgtctacttctgtcgagggggtcgtagggacaacgngcgtgcgtggtcgggcgggacgggcctagtcgtcgttaccggttcgttacggtaccgacggccccgaacgggcccgttcccggcccccgttcggtcctacccgttctcccgttccccgtaaccccg

SEQ ID NO: 367247 - DNA, 557 bp, Homo sapiens
  misc_feature: GZ8MTXP01CPEIL.13.9.A09.1.454.CMB.2.raw
  modified_base (360)..(360): a, c, t, g, unknown or other
  modified_base (469)..(469): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggagatgtattgaactaacgagtatggttcctggtatcagcagaaggcaggccacgccccctgtccctactcatcttacaaaactccaggccgccctcgtcggggtccctgagcgattcctccccggctccgctctaggaaacacncgtcactctcgaccatcgacgcgggacccagcctattgatgagtctgtctacttctgtcgagggggtcgtaggggacacgagcgtgcgtcggtcggcgggacgggaccnggtctcggaccggttcgttacggtccgacgccccgaggcccgtccgcccccgtggtccctaccgttccttcccgttcccctaaccccg

SEQ ID NO: 367248 - DNA, 571 bp, Homo sapiens
  misc_feature: GZ8MTXP01AEIY4.13.9.A09.1.454.CMB.2.raw
  modified_base (189)..(189): a, c, t, g, unknown or other
  modified_base (216)..(216): a, c, t, g, unknown or other
  modified_base (445)..(445): a, c, t, g, unknown or other
  modified_base (472)..(472): a, c, t, g, unknown or other
  modified_base (487)..(487): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagcctacatcacctgctctgganatgtattgactaacgagtatggttcctggtatcagcagaaggcaggccagccccctgtcctactcatctttacaaaatccaggccgccctcgtcgggggtccctggacgtcgacttccgtccccggcctccggtccctcgtggggaaaaccctcgaacggtccaactctacgacctagtcgaacgccggggacccaggctaagtgagtggaggtctgaccttattacgngtcgaggggtcggtggggacagacgancgaacgtcgcccgtntatcgtcgttaacggaacgttcgggaccagggtcctaacgcgttaacgccaacgaccaacggtcccacccacgtcgcgtaaccg

SEQ ID NO: 367249 - DNA, 588 bp, Homo sapiens
  misc_feature: GZ8MTXP01B9UZY.13.9.A09.1.454.CMB.2.raw
  modified_base (190)..(190): a, c, t, g, unknown or other
  modified_base (217)..(217): a, c, t, g, unknown or other
  modified_base (452)..(452): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctgganatgtattgactaagagtatggttctggtatcagcagaagcaggccagccccctgtcctactcatctttacaaaactccaggcgccctcgtcggggtccctgacgcgtacttccgtcccccggctccgcctcgtcggggaaaaccacaagtccaaccgtctacgaccatcgacggccgggacccagcctattcgatgaggtctgtctacttctgtcgaggggcgtagggacaacgngcgtgcgtcggtcggcgggtacggaccgaggtccgtcggacccggttcgttacggtaccgtacggccccgaagggcccgtcccggccccccgttcgggttccctaccgttcccgttcccggtttcccccgtccccg

SEQ ID NO: 367250 - DNA, 588 bp, Homo sapiens
  misc_feature: GZ8MTXP01D9UAT.13.9.A09.1.454.CMB.2.raw
  modified_base (192)..(192): a, c, t, g, unknown or other
  modified_base (390)..(390): a, c, t, g, unknown or other
  modified_base (404)..(404): a, c, t, g, unknown or other
  modified_base (471)..(471): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcacctgctcgtggagtatgtattgaactaacgagtattggttcctggtatcagcagaaggcaggcccacgcccccctgtccctactctacttactttaacaaaactacccgaggtcccggccctcggttcggggtcccctggacgcgtacttccgtccccggcctccgccgtcgtacggaaaccnctgcactctcaccntcgacgccggacctaggcctatgagtgacgtctgtcttactgtgtcgaggggcggtacggacaacgngtcggtcgtcgttagggtcggacgggtacgccgtagtcgtcgaccgttcgttacgtcgaccgttccgagttcccgtccgtccccgtggtccctcgttccgtcccgttcccttccccg

SEQ ID NO: 367251 - DNA, 639 bp, Homo sapiens
  misc_feature: GZ8MTXP01BYBUD.13.9.A09.1.454.CMB.2.raw
  modified_base (363)..(363): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccacgccccctgtcctactcattctttacaaaactccaggccgccctcgtgggggtcccctgagcgattccgtccccggcctccgcctcgtgggaaaccncaagtcactctcgaccatcgacggccgggacccagcctagttcgagttggacggtctgttccttacttctgtccgagggggtcgttaggggaaccaacgaggtccgtgtcgttacgggttcggggaccgggtacggggtacccgtaggttccgtcgggttacccggtttcgttaacggggtcccgaacgggttacccccgaacgggttcccgtcccggtccccccgttcgggtccctacccgtttcccgttaacccggtttcccccttaacccccg

SEQ ID NO: 367252 - DNA, 617 bp, Homo sapiens
  misc_feature: GZ8MTXP01EDZZU.13.9.A09.1.454.CMB.2.raw
  modified_base (190)..(190): a, c, t, g, unknown or other
  modified_base (217)..(217): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccgganagacagcctacatcacctgctctgganatgtatgactaacgagtatggtctggtatcagcagaggcaggccacgccccctgtcctactcattctttacaaaactaccgaggccgtccctcgtcgggggtccctgacgcgtacttccgtccccggcctccgcctcgtacgggaaaccactgtccacgtctacgaccagtcgacggccgggacccaggtcctagttgaagtcggacggtcttcgtcttacttcgtgtcgacgggggtcggtcggggaacaacgaggtcggtgtcggttcggttcggggacggggtacggtaccgcggtcgtcggttaccggttcgttacgggtccgacggccccgacgggttcccgtcccggtccccgtcgggttccctaccgttcccgttcccgttccccgtccccgg

SEQ ID NO: 367253 - DNA, 617 bp, Homo sapiens
  misc_feature: GZ8MTXP01EYWS7.13.9.A09.1.454.CMB.2.raw
  modified_base (192)..(192): a, c, t, g, unknown or other
  modified_base (334)..(334): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtcccgtgtccccccgganagacagcctacatcacctgctctggagatgtattgactaacgagtatggttctggtatcagcagaaggcaggccacgccccctgtcctatcattcttacaaatccaggccgcctcgagggctcccgtgacgtcgatttcccnctcggctcccaactcgtagggaactcacgccactctgaacctatccgacgccgggacccaggcctagtaggatggacgtctcgtaacttagttaccgtgggttacgaacggggtcggtacggggacacggacgacggaccacgttccgaccccggtctaagtcggtttacgtttaccgggaaaccgttcggggaaacccgaacgggtttcccgacccggttacccgtaaaggtaccgaacccgaaccccggaacggaccccctaaaccccgttcgttaacccg

SEQ ID NO: 367254 - DNA, 661 bp, Homo sapiens
  misc_feature: GZ8MTXP01DMLFP.13.9.A09.1.454.CMB.2.raw
  modified_base (459)..(459): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggagataaagtgggggataaatatgcttgctggtatcagcagaagccaggccacgtcccctgtcgctggtcatctatacaaagtactaaccgaacggccggacccgtacgacgggtactcccgtggacgcgtattcctacgtcggtaccctaccgtaaccgtcgtaagggaaacccacgaacgtcccaactccgtacgaaccaagtccgagggacccggacccgaggtccgtaggtgggtaacgnggacggtctagtaacgttacgttacggtcgtacggtacgggtcggtacggaacgacggccgtacgtaccgtacgttccggtaacccgtttaccggttaacgggtaaccggttaccgggtaaacccgtaacggttacccgttacccggttaccgtaacggacccgaaccgaccccgaaccgacccctaacccgttcgtaaccg

SEQ ID NO: 367255 - DNA, 589 bp, Homo sapiens
  misc_feature: GZ8MTXP01B7YO3.13.9.A09.1.454.CMB.2.raw
  modified_base (252)..(252): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatattgtgagggatagatatgtcttgttggtatcaanagaggccgcagtcactacattggtatctatgaagacacgaagcggccctgaagggactccctagacgcgtattcctctgctaccaacgtcgtacgggaacacgacgccactctacgaccatccgagccgggaccagacctagtacggatgaaggctgacttattaccgtgtacaagttaacgagtacgggaaactacgtattaagttggaagttcgggtcgtgggttaacgggcgggttaacgggaacccaaacgtcggtacccggttacgttacgggttaccaaccggacccggaaggtccccgtccggttacccccgttcggttcccgtaacccg

SEQ ID NO: 367256 - DNA, 582 bp, Homo sapiens
  misc_feature: GZ8MTXP01DCBEU.13.9.A09.1.454.CMB.2.raw
  modified_base (276)..(276): a, c, t, g, unknown or other
  modified_base (283)..(283): a, c, t, g, unknown or other
  modified_base (298)..(298): a, c, t, g, unknown or other
  modified_base (315)..(315): a, c, t, g, unknown or other
  modified_base (418)..(418): a, c, t, g, unknown or other
  modified_base (423)..(423): a, c, t, g, unknown or other
  modified_base (429)..(429): a, c, t, g, unknown or other
  modified_base (442)..(442): a, c, t, g, unknown or other
  modified_base (448)..(449): a, c, t, g, unknown or other
  modified_base (453)..(453): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgcttattttaaaaggtgtccaatgtgagctgcagctgggtggagtcgtgggggaggtttggtacaggccaggggccggtcctgagactctcctgtataactctggattcaattggggtnattatgntatgaactgggtccncaggctcgagggagggntggagtggggtagtttcaattaggagcaatttctacaattgagtacgggaacaaacagaatacgcgcgtctaaaggaaaaggcaagtattccaacctatctanaaganatggancagaaagcaatcnctttcnnaganaggagtagtacgacgaacgaacgacgacgaacacgtacactactattaactgttgtagttagtaagtaagttagttcgttacgtaacgtaccgtaaccgtacgtacgttacgtaacggttcggggtcgg

SEQ ID NO: 367257 - DNA, 618 bp, Homo sapiens
  misc_feature: GZ8MTXP01BW982.13.9.A09.1.454.CMB.2.raw
  modified_base (189)..(189): a, c, t, g, unknown or other
  modified_base (200)..(200): a, c, t, g, unknown or other
  modified_base (211)..(211): a, c, t, g, unknown or other
  modified_base (216)..(216): a, c, t, g, unknown or other
  modified_base (230)..(230): a, c, t, g, unknown or other
  modified_base (441)..(441): a, c, t, g, unknown or other
  modified_base (465)..(465): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagcctanatcacctgctntgganatgtatgactaagngtatggtctggtatcagcaggaagcaggccacgccccctgtccctactctacttactttacgaaaactcccaagggtccgacccctcggttcgggggtcccctaggacgcgtacttccgtccccggcctccgccctacgtcgggaaaacactgtccaacttcacgacccatcgacgccggaccagcctatcgatgagtctagtctacttcnggtcagggggcggtaggacaacgngccgtgcgtcgggtcggcgggacggacctaggtcctaggacccgttacgttcggacctaacggttccccgttaaggggccccttccccgggcccccccgtttcggggcccctaccccggtttccctccccgggttttcccccccgtaaccccg

SEQ ID NO: 367258 - DNA, 610 bp, Homo sapiens
  misc_feature: GZ8MTXP01D9TS6.13.9.A09.1.454.CMB.2.raw
  modified_base (191)..(191): a, c, t, g, unknown or other
  modified_base (219)..(219): a, c, t, g, unknown or other
  modified_base (499)..(499): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatcgtcccgtgtcccccgganagaccagcctacatcacctgctctgganatgtattgaactaacgagttatggttctggtatcagcagaaggcaggcccacggccccctgtacccctactcctagttacctttaacaaaactaccgaggccgccccttcgtcggggtccctgacgcggtacttccgtccccggcctccgctacgtacgggaaaaccacgtaacgtccactcctacgaaccctagtccgaaacgggccgggaaccccagacccgtattggattacggaggtctcgtctacgttctgtcgaggggtcgtagggaacaacgngtcgtgtcgtcgggttcggcgggacggccaggttcgtcggttaccgtgttacgcgacggcccgaggccctcccggtcccctcggtccaccttcctccgttcccctaacccg

SEQ ID NO: 367259 - DNA, 563 bp, Homo sapiens
  misc_feature: GZ8MTXP01EDT71.13.9.A09.1.454.CMB.2.raw
  modified_base (189)..(189): a, c, t, g, unknown or other
  modified_base (453)..(453): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagcctacatcacctgctctggagatgtattgactaacgagtatggttctggtatcagcagaaggcaggccacgccccctgtccctactcatctttacaaaataccaggccgccctcgtcgggggtccctggacgcgtattccgtccccggctccgcctcgtacgggaaaccacgcgtcaccgtctcgaccagtcgacggccgggacccagcctatgatgacggtctgtctacttctgtcgaggggcggtgggaacaacgngcgtgtcgtggttcgggacgggagggaccctaggtcgtcggttaccggttcgttaggacgacgcccgaaggctcggcctaaccgtcggtccacgttcttccgttaacccc

SEQ ID NO: 367260 - DNA, 776 bp, Homo sapiens
  misc_feature: GZ8MTXP01EDGF8.13.9.A09.1.454.CMB.2.raw
  modified_base (190)..(190): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccgganagacagcctacatcacctgctctggagatgtattgactaacgagtatggtctggtatcagcagaaggcaggccacgccccctgtcctactctatactttacaaaatccaggccggtccctcgtcgggggtccctggacgcgtacttcgtcccccggctccgcccgttcgacggggaaaaccctacgtaacgtcctaaccttccgttacggaacccctataccgacgggtacccggggaccccgacggtacccgttaacgttcggtaagttacggtaacggtaccgttacggttcccttaaccgtttcggttacgtaccggtacggggggttaacggggttacgggggtaaaccgaaacggtaacggtccggttacggtccggttcgggggtttacccggggaccgggggtaacggggtacccggtaacgggttcccggtacgggttaaacccgggttccgtttaaccggggtaccgtaacccgggaccccgttaaacggggttccccggttcccgggtaccccccccgttcggggttccccttaacccggttccccgttccccggtttccccccgtttccccccgg

SEQ ID NO: 367261 - DNA, 740 bp, Homo sapiens
  misc_feature: GZ8MTXP01DLENC.13.9.A09.1.454.CMB.2.raw
  modified_base (192)..(192): a, c, t, g, unknown or other
  modified_base (219)..(219): a, c, t, g, unknown or other
tcagtcacgtactacacgaccggtgctcgatttagcgagacgcgcagggggctgggcctcaggaggcagcatcggaggtgcctcagccatggcatggatccctctcttcctcggcgtccttgcttactgcacagaatccatggcctcctatgagttgactcagccaccctcatcgtccgtcgtcccccgganagacagcctacatcacctgctctgganatgtatgactaacgagtattcggttctggtatcgagcaggaaggcacggccacgccccctgtcctactcattctttaacaaactccgaggcccggtccctcggtcggggtccctggacgtcgtacttccgtccccgcctccgcctcgtacgggaaacccacgtcgtccaccttcgtacgaaccctagtccgacgggcccgggtaacccacggttacctagtttcggacgttagggacgggttcttcgttaccttaccgttcgtacgggttaccggaaggggggttccggtaacggggaaccaaacggtcgggtccggttcgggtaccggtttcgggggttaccgggggacggggtaaaccggggtcccgttaacgggttccggttaccgggttacccggtttacggtttaacgggtacccggaaccgggttaccccggttacgggttccccgttccccgggttccccccgtgggttacccctacgggtttcccgttcccgggtttaaccccccgttcccgg

SEQ ID NO: 367262 - DNA, 594 bp, Homo sapiens
  misc_feature: GZ8MTXP01BWZ4X.13.9.A09.1.454.CMB.2.raw
  modified_base (365)..(365): a, c, t, g, unknown or other
  modified_base (437)..(437): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttctggtatcagcagaaggcaggccacgccccctgtcctactcatctttacaaaactaccacggccggcccctcgtcggggtccctgagcgtattcctccccggctccgcctcgtcgggaaacacngtcactctacgaccatcgacgccgggacccaggcctagttgagtggaggtctgttccttacttcgtgttcgngggggtcggtcggggacaacgagcgtggcgttggttccgggcgggacggggccaggtccgtgttacccggttcgttacgggtccaacggccccgaacgggttcccgtcccggtcccccgttcggtaccctccgttccgttccgttcccccgtccccg

SEQ ID NO: 367263 - DNA, 659 bp, Homo sapiens
  misc_feature: GZ8MTXP01CV60N.13.9.A09.1.454.CMB.2.raw
  modified_base (270)..(270): a, c, t, g, unknown or other
  modified_base (295)..(295): a, c, t, g, unknown or other
  modified_base (316)..(316): a, c, t, g, unknown or other
  modified_base (352)..(352): a, c, t, g, unknown or other
tcagtcacgtactacacgaccggtgctcgatttagcgagacgcgcaggggggagaggagccccagccgtgagattcccaggagtttccacttggtgatcagcactgaacacagaccaccaaccatggagtttgggcttacttgggttttccttgttgcttaattttaaaaggtgtccaatgtgagctgcagctggtggagtcgtgggggaggttggtacagccgagggcgtcctgagactctcctgtataacttctgattcaattgggtntattagtgctatgaacgtgggtccnccgaggctccgaggggagggntgggagtgggtagtttcagttaggagctaatttcanagtgagtagggacaaacgagaacgtacgccgtacgtactaaaggtaaaaggcaagtacttaccaacctatcctaacgaaagagtaatggaacgtccgaaaggaaacgcctaacgttccgtcccttttcgagacgaagtacgtagggtaacggttaacgccctaaagggaaaccgaacccggaaggaacctaacgacgccctaagttaccttaattaacgtgttagtacgttaaggaaaggtgtttaattcggacctaagttccccgtaaggtcccgtggttaccgttaaggggttcggggggttccg

SEQ ID NO: 367264 - DNA, 664 bp, Homo sapiens
  misc_feature: GZ8MTXP01ES12D.13.9.A09.1.454.CMB.2.raw
  modified_base (188)..(188): a, c, t, g, unknown or other
  modified_base (216)..(216): a, c, t, g, unknown or other
  modified_base (239)..(239): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctctatgagttgactcagccaccctcatgtccgtgtcccccgganagacagcctacatccacctgctctgganatgtatgactaagagtatggtcnggtatcagcagaaggcaggccacgccccctgtcctactcacttactttacaaaactccgaggtccgtcctacgtcgggggtccctgacgtcgtactttccgtccccgggcctccggccttcgtacggggaaaaccaccgaacgttcaccttcctacgaccctacgttccgaacggtcccggggaacccaggtacccttaagttcgagttacggacgtccgtgttcttaccgttcgtaggttccggaagggggccggttaaggggaaacctaacggtacgccggtgtccggttcggggttccggtacggggaacggacccgtaggtcgtacgttaccggttcgttacgggtacaaccggttacccgagggccctcccggccccgttaacggtccctaccgttcctcccggttcccccgtaaccccg

SEQ ID NO: 367265 - DNA, 691 bp, Homo sapiens
  misc_feature: GZ8MTXP01D0VR2.13.9.A09.1.454.CMB.2.raw
  modified_base (193)..(193): a, c, t, g, unknown or other
  modified_base (286)..(286): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcacgccaccctccatcgtccgtcgtcccccgganagacagcctacatcacctgctctggagatgtatgactaacgagtatggttcctggtatcgagcagaaggcacggccacgccccctgtcctacnctactacttacaaaactccgaggccgtccctcgtcggggtccctgacgtcgtacttccgtccccggcctaccgccttccgtacggggaaaacccactcggtaccaccgttaccgtacgaacccctagtaccgaccgggacccgggaaccctacggtacccttagttacggtaacgtgggtaacggtctttcggttaccttacgtttcgtaggtccgacggggggtcgttacggggaaccaaacgaggtccgtggtcgttacggggttccgggaccggggtacgggaccgtaggtccgtcggttacccggttcgttacgggtaccacggacccgaacgggttccgtaaccccggtcccccggttcggtccctaccgttccgttaacccgttcccccgttaaccccg

SEQ ID NO: 367266 - DNA, 637 bp, Homo sapiens
  misc_feature: GZ8MTXP01A333Z.13.9.A09.1.454.CMB.2.raw
  modified_base (192)..(192): a, c, t, g, unknown or other
  modified_base (234)..(234): a, c, t, g, unknown or other
  modified_base (248)..(248): a, c, t, g, unknown or other
  modified_base (324)..(324): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcacctgctctggagatgtattgactaagngtatggtctggtancagcagagcaggccacgcccctgtcctactctacttctttacaaaactccgaggccggtccctcggtcgggtcccngacgcgtattccgccccggcctccgcctcgtacgggaaaccacgcgtcacctctacgacctagtcgacggcccgggacccacgtccttagttcgagtcgacggtcttcggttacttacgttcgtacggtccgagggggtcggtacgggaaccacgaggtcgtaggtcgttcgggttcggggacgggacgggtacctacgggtccgtacggttcccggttacgttacggtaccgaccggttacccgacgggttcccgtaacccggtcccccgttaacggtccctccgttccgttccccggttcccctaaccccg

SEQ ID NO: 367267 - DNA, 769 bp, Homo sapiens
  misc_feature: GZ8MTXP01C0306.13.9.A09.1.454.CMB.2.raw
  modified_base (217)..(217): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccggacagacagcctacatcacctgctctgganatgtatgactaacgagtatggttcctggtatcagcagaaggcacggccacgccccctgtcctactcattcctttaacgaaaactccgacggccggaccctcgttcgggggccctggacgtcgtattccgtcccccggcctccgcctacgtacgggaaaaccactcgtccacctccgtacgaacccacgttaccgaacgggccccggggaacccacggtaccccttaagttcggtaacggtagggtacgggttccttacgggttaccttaccgtttcgttcgggttaccgggaacggggggtacccggggttaacgggggaaacctaaaccgggacggtcccgggttcgggtccggtttcgggggttacccgggggtaccgggggtaacgggtacccgttaacgggttcccgtacgggttaaccccgggtttcgttaacgggtacccgtacgggtttaacccggacgggttccccgttcccgggtcccccccgttaacggggttcccctaaccggtttcccgtttaacccccggttccccccgttaacccccg

SEQ ID NO: 367268 - DNA, 778 bp, Homo sapiens
  misc_feature: GZ8MTXP01AQPIC.13.9.A09.1.454.CMB.2.raw
  modified_base (190)..(190): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatccacctgctctggagatgtattgactaagagtatggttcctggtatcagcagaaggcaggccacgccccctgtcctactctattacctttacaaaactccgagggccgtaccctcgtcgggggtccctggacgtcggtacttccgtccccggcctccgccgttcgtacgggaaaacctaccgtaacgtcctaccgttcgtacgaaccctagtaccgacggacccgggaaccctacggacccttagttcggaagtttcggacgggtcttcggttaccttacgtttccgtcggttaccggacggggggtaccgggttaaggggtaacccgaaaaccggtacgggtccggttcggtaccgggtttccggggttaccgggggtaccgggggaaccggggtaacccgttacgggttaaccgtccgggttaaccccgggtttaccggttaccggggttaacccgaaccgggttacccccggttaaacggggttccccgttaaccccgggtcccccccggttaacggggttacccctacccgttccccgtttaaccccggtttcccccccgttaacccccgg

SEQ ID NO: 367269 - DNA, 565 bp, Homo sapiens
  misc_feature: GZ8MTXP01AFTNH.13.9.A09.1.454.CMB.2.raw
  modified_base (297)..(297): a, c, t, g, unknown or other
  modified_base (490)..(490): a, c, t, g, unknown or other
tcagtcacgtactacacgaccggtgctcgatttagcgagacgcgcaggggggagaggagccccagccgtgagattcccaggagtttccacttggtgatcagcactgaacacagaccaccaaccatggagtttgggcttacttgggttttccttgttgcttattttaaaaggtgtccaatgtgagctgcagctggtggagtcgtgggggaggtttggtacagccagggcggtccctgagactctcctgtataacttctggattcaacttggggtgtattatgctatgaactgggtccnccgaggctccgagggagggctggaggtggggtaggtttcagttaggagtctaattctacattgatgggaacaacgagaatacgccgcgtctaagtaaaaggcagtacttcacctatctacaaagagactagacgtcaagacgacatccgtctttcgtgcagatgggagtacgcctaggaacgaccgagacacncgtccatcctattaactgttgcttaggagtagttgttcgactaagtcctaacgactgcgtaaggttcgggggtcg

SEQ ID NO: 367270 - DNA, 645 bp, Homo sapiens
  misc_feature: GZ8MTXP01AGJ2I.13.9.A09.1.454.CMB.2.raw
  modified_base (275)..(275): a, c, t, g, unknown or other
  modified_base (297)..(297): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgcttattttaaaaggtgtccaatgtgagctgcagctgggtggagtcgtgggggagtttggtacagccaggggcgtcctgagactctcctgtataacttctggattcaacgttggggtnattatgctatgaactgggtccncaggctcgagggagggctggagtgcgttcttcttttattatagtagtggtaagtacattacctcgcagaccctccggtggacgggggtccctattacccgacctaattcctacccgaagacgaacctaattaccaaagaaccacgtctttagtttaccttacaaatacgaaacagtaccctaggaacgacgacccgtatacggggacgaccgggtccgtagttaacttacgtggtcgacggagaggtacggtccggggacccaaggtaacgtttacgaccgcgttagcgggttacgttcggttacgggggaacccaagggcccgacggtccaccgtccttccgaaccg

SEQ ID NO: 367271 - DNA, 672 bp, Homo sapiens
  misc_feature: GZ8MTXP01C1MAA.13.9.A09.1.454.CMB.2.raw
  modified_base (277)..(277): a, c, t, g, unknown or other
  modified_base (300)..(300): a, c, t, g, unknown or other
  modified_base (343)..(343): a, c, t, g, unknown or other
  modified_base (353)..(353): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgcttattttaaaaggtgtccaatgtgagctgcagctgggtggagtcgtgggggaggttggtacaggccaggggccggtcctgagactctcctgtataacttctggattcaacgttgggtnattatgctatgaacgtgggtccncaggctcgaggggaggctggagtggggtagtttcagttagganctaattctanagtgagtgggaacaacgagaactacggccgtacgtcgtaaagggttaaaacggctaaagtactttaccaaccctatccctagaaagagtaagtaggaacgtaccgaaaggaaacgctaacgttcccggtacccttttcgacgacctaagtagtaggggtaacggtaacgtcccgtaagggaaacgaaccccggaagggaccaaacgacgtaccctaataccgttaatttaacgtggttacgtacgttaaggtaagtaggttaacttcgactaacggtccctaacggaccgtgttacgttaagggttcgggggttcccgg

SEQ ID NO: 367272 - DNA, 738 bp, Homo sapiens
  misc_feature: GZ8MTXP01D8H20.13.9.A09.1.454.CMB.2.raw
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcattcgtccgtcgtccccaggcagacagccacatactgctctgattattgtgaggtatagatatgtcttgttggtatacaacgagaacggccgcagtcacctacattgtatctatgaagcaacgagccggccctgagggactcccgtgacgcgtacttcctcgtcggcctacccgaaaccttcgtaacggggaaaccacgtacgaccctccgttactacgaaccctacgtaccgaacgggcccggggaacccctacggaccccttaacggtacgggtaacgtagggtacgggtaccgttacgggtaaaccgttttaactttaacggtttcggttaaccttaaacgttaacgtaacggttaacgggggaaaccctaaacggtaaagtttaaggttacggggtaagtttcgggggtacggttaacggggtttaccgggggaacgggggaaccggggttaaacccgtaaaccggttaccgggaaccccggttccggttacgggtaacccgaccggtaaccccggtaacggggtccccgttacccgggtcccccccgttcggggtttcccccg

SEQ ID NO: 367273 - DNA, 642 bp, Homo sapiens
  misc_feature: GZ8MTXP01BF8W8.13.9.A09.1.454.CMB.2.raw
  modified_base (189)..(189): a, c, t, g, unknown or other
  modified_base (328)..(328): a, c, t, g, unknown or other
  modified_base (356)..(356): a, c, t, g, unknown or other
  modified_base (365)..(365): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctctatgagttgactcagccaccctcatcgtccgtgtcccccgganagacagcctacatccgacctgctcgtggagatgtattgactaacgagtatggtcctggtatcagcagaaggcacggtccacgccccctgtcctactcattctttacaaaatccgaggtccggccctgtcggggtccccngacgcgattccgcccggctccgctacgngggaaaccncgtcgccactctacgaccagtacgacggacccgggaccctacgtaccttagttagagtacggacgttcgttcgttaccttacgttcgtacggtacgacgggggtcggtacgggaccaacgtggtcgtcgtccggtcgggtccgggacgggtaccgggtaccgtcggtaaccgtcggttacccgttcggttacggtaccgtaccgcccggttacggttccccgtccccggtcccccgttaaccggtccctaccgttcccgttcccgttccccgtcccc

SEQ ID NO: 367274 - DNA, 737 bp, Homo sapiens
  misc_feature: GZ8MTXP01DNUDO.13.9.A09.1.454.CMB.2.raw
  modified_base (201)..(201): a, c, t, g, unknown or other
  modified_base (266)..(266): a, c, t, g, unknown or other
tcagtcacgtactacacgaccggtgctcgatttagcgagacgcgcaggggctgggcctcaggagacagcatcggaggtgcctcagccatggcatggatccctctcttcctcggcgtccttgcttactgcacagaatccatgcctctatgagttgactcacgcccaccctcatcgtccgtcgtcccccggaagacagcctanactccacctgcttcgtggaatattgttaattagtaacctaagtagttagttcggttccgtggtancgagcgaagaacggcacggtcccaccgtcccccttgtacctactctactttacctttaacaaaaccgtccgacgggcccgtaccgttcgggtcgggccctaggacgtctacgttccccgtccccgccgtccgtccgtacgtacggaaaaccacgtcgtacctaccgtcgtaacgacccagtccggaaccgggacccgggtaccacgtaccgttagttagtaggttacgggtaacgtctttacggttaccttacgttcggttaacgttccgggaacgggggttcggggttaaacggaaaccgtaaaccgggtggtcggttcggtacgggtttccgggtccgggggaaccgggtacggtaccgtcggttaaccggtacggttaccggttacgttccgggtacgtccgggaaccgttcggttccccgtcccgtaccccgttcgtaccctcttcccgtttccgttccccgttccg

SEQ ID NO: 367275 - DNA, 624 bp, Homo sapiens
  misc_feature: GZ8MTXP01A5YBU.13.9.A09.1.454.CMB.2.raw
  modified_base (189)..(189): a, c, t, g, unknown or other
  modified_base (216)..(216): a, c, t, g, unknown or other
  modified_base (232)..(232): a, c, t, g, unknown or other
  modified_base (242)..(242): a, c, t, g, unknown or other
  modified_base (378)..(378): a, c, t, g, unknown or other
  modified_base (598)..(598): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtgtcccccgganagacagcctacatcacctgctctgganatgtatgactaagatntgtctggtancagcagaagcacggccacgtccccctgtaccctactcacttactttacaaaaacgtcccgaacgggccggtcccctcggtcgggggtacccctggacgtcgattccgtccccggctaccgctcgtacgggaaaccncgtaacgtcactcgtacgaccagtcgacggcccggtaaccaggtcctatcgattggacggtcttagtccttacgttcgtcgtccgggtaggggccggttaggggacaaaccgtgggtccgttcggcgttcggggtacggggcgggtacggtacccgaggtcgtcggacgttcggttaaggccgacgacccgttacgggcctcccgccccgttcggtaccncccgttctcccggttcccctaacccg

SEQ ID NO: 367276 - DNA, 690 bp, Homo sapiens
  misc_feature: GZ8MTXP01AEFPO.13.9.A09.1.454.CMB.2.raw
tcagtcacgtactacacgaccggtgctcgatttagcgagacgcgcaggggctgggcctcaggaggcagcatcggaggtgcctcagccatggcatggatccctctcttcctcggcgcccttgcttactgcacagaatccatggcctcctatgagttgactcacgccaccctcatcgtccgtcgtcccccggaagacacgcctacactccactgctcgtaggatattgtattacgaactaacgagttagttcggttcctggtactcgagcgaaggaacggcacggcccacggtccccctgtcctactctacttaccttaacaaaacgtccgacggtcccgtcctcggtcgggtcctaggacgtcgtacttccgtccccggtcctccgcgttacgacggaaacctcgtaacgtcctactcgtacgaacctagtaccggaacgggacccgggtaccctacgtaccgttaaggttcggacgtacgggtacggtctttacggttccttacgttcgtacggttcggacggggggtacggtaccggaacgaaccgtggtcggtcgtcggttcggggtccgggcgggtacggcgtcgggttcgacggttccggtcggttaccggccgaaccggcccgttacggttccccgtcccggtaccccgtcggtacctccgttccgttcccgttcccctaacccg

SEQ ID NO: 367277 - DNA, 751 bp, Homo sapiens
  misc_feature: GZ8MTXP01A1F2K.13.9.A09.1.454.CMB.2.raw
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccggacagacagcctacatcacctgctctggagatgtattgactaacgagtatggttcctggtatcagcagaaggcaggcccagccccctgtcctactcatactttacaaatccaggcgccctcgtcggggtcctgacgcgtacttccgtccccggcctccgccctcgtacggggaaacacaagtccactctcgacccatccgacggacccggggacccacggtcccttagttacggacttacggggtacgggtccgttcgggtttaccttaaccgttttcgttacgggttaccggtacgggggggggtacccggggtttaacggggggaaaccctaaaaccggtacggggtccggttcggggttacccgtttcggggggttttacccgggggaccgggggtaaccgggggtaacccgtaacggggttccgttacgggttaccccggtttccggtttaacgggtaccgtaaccggttacccccgaaggggttcccgttaaccccggtccccccggttcgggttcccctacccgtttcccttcccgggtttccccccgttccccccg

SEQ ID NO: 367278 - DNA, 628 bp, Homo sapiens
  misc_feature: GZ8MTXP01AXE2F.13.9.A09.1.454.CMB.2.raw
  modified_base (189)..(189): a, c, t, g, unknown or other
  modified_base (215)..(215): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctctatgagttgactcacgccacctcatcgtccgtcgtccccgganagacagcctacatcactgctcgtganatgtatagaactacgagtagtcgttctggtactcgagcaggaagcgacggccacgcccctgtcctactctaattcttaacaaacgtccgaggtccgtccgtcggtcggggtcctgacgtcgtacgttccgtccccggtcctaccgtcgttacggacggtaaaccaacgtcgtcctaactccgttacgacctacgcgacggtaccgggacacggtctagtagagtcggacgtctacgtacttacgtcgtacggtcggacggggtcgggtaggactaacggcggtcgtacggtcgttcgggtaccgggaccgggtacgtccgtgggtctcggttaaccggttcgaacgtccgacgttacccgacggttccgaacccgttcccgcgttaccgtcttccgtccgttcccctaacccg

SEQ ID NO: 367279 - DNA, 671 bp, Homo sapiens
  misc_feature: GZ8MTXP01EZ93F.13.9.A09.1.454.CMB.2.raw
  modified_base (193)..(193): a, c, t, g, unknown or other
  modified_base (220)..(220): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatcgtcccgtcgtccccccgganagacagcctacatcacctgctctgganatgtattgactaacgagtatggtcctggtatcgagcaaggaaggacgccacgtccccctgtacctactacagttacctttaacaaaacgtaccgacggccggtccctcgtacgggggtccctggacgcgtacttccgtccggccctcccgtctcgtacggaaccaacacgtcctactcacgaccagtacgacgggcccgggacccagtaccttagtgagtggtacggtccttgtaccttactcgttcggtacgaacgggtcgggggtaacggaaccgtaaacgcggtcggttcggccgttaacggggtccggggacgggacggggtaccctaagggtccgttaaggtcccggtttacgtacgggttacccgacggaccccgaacgggttcccttcccggtcccccgtcgtcctacccgtcccgttccgttaacccccgttcccgtttcccg

SEQ ID NO: 367280 - DNA, 658 bp, Homo sapiens
  misc_feature: GZ8MTXP01BTAJ5.13.9.A09.1.454.CMB.2.raw
  modified_base (191)..(191): a, c, t, g, unknown or other
  modified_base (196)..(196): a, c, t, g, unknown or other
  modified_base (212)..(212): a, c, t, g, unknown or other
  modified_base (344)..(344): a, c, t, g, unknown or other
  modified_base (349)..(349): a, c, t, g, unknown or other
  modified_base (391)..(391): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctctatgagttgactcacgccaccctcatcgtccgtcgtcccccgganagacngcctacatcactgctntggatatgtatgaactaagagttagttggttcctggtatcgagacgaaggaacggcaacggcccaccggtcccccttgtccctactctacttacttaacaaactccgacggtccgtccctcgtcggggtccnggacncgtacttccgtccccggcctccgcctacggtacggaaaaccncgtgtcctaactccgtacgaacccagtacggacgggcccggtacccaggtaccttagtgacgtggacgtcgtgttctacgttcgtgtacggagggggtcgtaggaaccaagtcggacgtgtcggtcgggtcggccggggtaacggtccgtacggtccgtacggttaccgttacggttacgtccgaaccggttacccgttacgggttcccctcccggtcccccggtaacggttccctaccgtttcccgtaaccgttccccccgttccg

SEQ ID NO: 367281 - DNA, 500 bp, Homo sapiens
  misc_feature: GZ8MTXP02JXKAB.13.9.A09.1.454.CMB.2.raw
  modified_base (329)..(329): a, c, t, g, unknown or other
  modified_base (344)..(344): a, c, t, g, unknown or other
  modified_base (351)..(351): a, c, t, g, unknown or other
  modified_base (353)..(353): a, c, t, g, unknown or other
  modified_base (447)..(447): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttacaaaataccaggcggccctctggggtccctgagcgattcnccccggctccgctcngggaacncngtcactctgaccatcagcggacccagcctatgatgaggctgtctacttctgtcaggcgtgggacacgagcgtgctgtcggcggagggccagtcngaccgtctaggcacgcccaaggctcgcccctcggtcactcctcgtcccgtccc

SEQ ID NO: 367282 - DNA, 524 bp, Homo sapiens
  misc_feature: GZ8MTXP02GD2Q3.13.9.A09.1.454.CMB.2.raw
  modified_base (332)..(332): a, c, t, g, unknown or other
  modified_base (355)..(355): a, c, t, g, unknown or other
  modified_base (357)..(357): a, c, t, g, unknown or other
  modified_base (428)..(428): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtccctactcatctttacaaaatccaggccggccctcgtcggggtccctgagcgattcnccccggctccgcctctgggaacncngtcactctgacccatcagccggacccagcctatgatgaggctgtctacttctgtcaggcgtgggacaacgngcgtgcgtggtcggcggacggccagtctcgaccgtcgttacggcacgaccgaggcctccgtccccgtcggtcctccgtccgttccgtccccgtccc

SEQ ID NO: 367283 - DNA, 541 bp, Homo sapiens
  misc_feature: GZ8MTXP02G6WD7.13.9.A09.1.454.CMB.2.raw
  modified_base (190)..(190): a, c, t, g, unknown or other
  modified_base (353)..(353): a, c, t, g, unknown or other
  modified_base (355)..(355): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccacgcccctgtcctatcatctttacaaaactccaggcggccctcgtcggggtccctgagcgattcgccccggctccgctcgtcggaacncngtcactctacgaccatcgacggaccgggacccagcctaagttgagtgaggtcttcgtacttacttctggtccgagggccggtgggacacgaggccgtggctggtcggcggaacgggcaggtctacggaccgttcgttaggcacggcccaaggcctcgccccgtcggtcacgtcgtcgtccctaccc

SEQ ID NO: 367284 - DNA, 501 bp, Homo sapiens
  misc_feature: GZ8MTXP02F93ST.13.9.A09.1.454.CMB.2.raw
  modified_base (191)..(191): a, c, t, g, unknown or other
  modified_base (329)..(329): a, c, t, g, unknown or other
  modified_base (351)..(351): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaacgagtatggtcctggtatcagcagaaggcaggccagccccctgtccctactcatctttacaaataccaggcgccctcgtggggtccctgagcgattcncccggctccgctctggaacacngtcactctgaccatcagcggaccagcctatgatgagctgtctactctgtcaggcgtggacagagcgtgctggtcggcggaggtcagtctcggaccgttcgttaggcacgcccgtaaggcctcgccccgtggtcacgtctcgtcccgtccc

SEQ ID NO: 367285 - DNA, 538 bp, Homo sapiens
  misc_feature: GZ8MTXP02JFR23.13.9.A09.1.454.CMB.2.raw
  modified_base (217)..(217): a, c, t, g, unknown or other
  modified_base (367)..(367): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctgganatgtattgactaacgagtatggttcctggtatcagcagaaggcaggccagccccctgtccctactcattctttacaaaataccaggcgccctcgtcggggtccctgacgcgtacttccgtccccggcctcccgcctcgtcggggaacacngtccactctgaccatcagccggacccagcctatgagtgacggctgtctactctgtcgaggcgtgggacacgagcgtgctggtcggcgggtaggaccagtcgtgaccgttcgtacggtcacgcccgaaggcctcggccccctcggtcctaccgtctccgttaccctaccccg

SEQ ID NO: 367286 - DNA, 525 bp, Homo sapiens
  misc_feature: GZ8MTXP02I43H2.13.9.A09.1.454.CMB.2.raw
  modified_base (191)..(191): a, c, t, g, unknown or other
  modified_base (357)..(357): a, c, t, g, unknown or other
  modified_base (359)..(359): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaacgagtatggttcctggtatcagcagaaggcaggccagccccctgtcctactcatctttacaaaatccaggccggccctcgtggggtccctgagcgattcctccccggctccgcctcgtgggaaccncngtcactctgaccatcgagccgggacccagcctatgatgaggctgtctacttctgtcaggcgtgggacacgagcgtgcgtggtcggcggagggaccaggtctggaccgttcgttaggtcacgccccaaggcctcgccccctcggtccaccgtctcgttcccctaccc

SEQ ID NO: 367287 - DNA, 550 bp, Homo sapiens
  misc_feature: GZ8MTXP02GZ67D.13.9.A09.1.454.CMB.2.raw
  modified_base (190)..(190): a, c, t, g, unknown or other
  modified_base (362)..(362): a, c, t, g, unknown or other
  modified_base (526)..(526): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttctggtatcagcagaagcaggccagccccctgtccctactcatctttacaaaatccaggccggccctcgtcggggtcccctggagtcgattcctccccggcctccgcctcgtcgggaacacncgtccactctcgacccatcgacggccgggacccaggccctattgagtgaggctgtctacttctagtcgaggcgtggacacgagcgtgctggtcggcggagggaccagtctacggaccgttcgttacggcacgaccccgtaaggcctccggcccccgtcggtccnccttcgtcccgttaccctaccccg

SEQ ID NO: 367288 - DNA, 533 bp, Homo sapiens
  misc_feature: GZ8MTXP02JSY8N.13.9.A09.1.454.CMB.2.raw
  modified_base (190)..(190): a, c, t, g, unknown or other
  modified_base (217)..(217): a, c, t, g, unknown or other
  modified_base (361)..(361): a, c, t, g, unknown or other
  modified_base (443)..(443): a, c, t, g, unknown or other
  modified_base (469)..(469): a, c, t, g, unknown or other
  modified_base (530)..(530): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctgganatgtattgactaacgagtatggttcctggtatcagcagaaggcaggccacgccccctgtcctactcatctttacaaaatccaggccgccctgtcggggtccctgacgcgtacttccgccccggctccgcctcgtcgggaacacngtcactcacgacccagtccacgccgggacccagcctagtgatgacggctgtcttacttcgtgtcgaggcgtagggacaacgngcgtgcgtgtcggcggacggtaccgngtccgtgaccgtcgtacgcgacgaccgacggcctccgcccgtcgcctacgtcgtcctcccnccg

SEQ ID NO: 367289 - DNA, 554 bp, Homo sapiens
  misc_feature: GZ8MTXP02HPK2K.13.9.A09.1.454.CMB.2.raw
  modified_base (191)..(191): a, c, t, g, unknown or other
  modified_base (355)..(355): a, c, t, g, unknown or other
  modified_base (412)..(412): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctacatcacctgctctggagatgtattgactaacgagtatggtctggtatcagcagaaggcaggccagccccctgtcctactcatctttacaaaatccaggcgccctgtcggggtccctgagcgattcctccccggctccgcctcgtgggaaccacngtcactctcgaccatcaggccggacccagcctatgatgaggctgtctacttctgtcnggcgtgggacacgagcgtgcgtggtcgggcggagggccaggtcgtcggtaccgttcgttacggggtccaacggccccgaagggccttccggccccccgttcggggttacccaccttccgttcccggtttcccccgtcccccg

SEQ ID NO: 367290 - DNA, 580 bp, Homo sapiens
  misc_feature: GZ8MTXP02HYC7Z.13.9.A09.1.454.CMB.2.raw
  modified_base (334)..(334): a, c, t, g, unknown or other
  modified_base (358)..(358): a, c, t, g, unknown or other
  modified_base (372)..(372): a, c, t, g, unknown or other
  modified_base (443)..(443): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccacccctccatgtcccgtgtcccccggacagacagcctacatcacctgctctggagatgtattgactaacgagtatggttcctggtatcagcagaaggcagaccacgccccctgtcctactcattctttacaaaataccaggccgccctcgtggggtccctgagcgattcnccccggctccgctcgtggaacacngtcactctcgaccntcacgccggaccagcctagttgagttgacggtcttcgtcttacttcgtgtcgaggtcggtagggacaacgngcgtgcgttggtcgggtacggacggggaccaggttctacgggtacccgttcgttacggtccacggtacccgaacggtcccgtccggtccccccgttcgggtaccctaccgttcccgttcccgtttccccgtcccccg

SEQ ID NO: 367291 - DNA, 555 bp, Homo sapiens
  misc_feature: GZ8MTXP02H2YWM.13.9.A09.1.454.CMB.2.raw
  modified_base (190)..(190): a, c, t, g, unknown or other
  modified_base (330)..(330): a, c, t, g, unknown or other
  modified_base (352)..(352): a, c, t, g, unknown or other
  modified_base (354)..(354): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtccctatcatctttacaaaataccaggcggccctgtcggggtccctgagcgatccncccggctccgcctcgtggaacncngtccactctgaccatcacgccggacccagcctatgatgaggctgtctacttctgtcgaggcggtgggaacaacgaggcgtggcgttgggttacgggcgggagggacccaggtccgtacggtacccgtcgtttagggccacggccccgaaggccctccggcccccgtcggtcctaccgttccgtccgtttcccccacccccg

SEQ ID NO: 367292 - DNA, 628 bp, Homo sapiens
  misc_feature: GZ8MTXP02HJPQC.13.9.A09.1.454.CMB.2.raw
tcagtcacgtactacacgaccggtgctcgatttagcgagacgcgcaggggctgggcctaaggaggcagcatcggaggtgcctcagccatggcatggatccctctcttcctcggcgtccttgcttactgcacagaatccatggcctcctatgagttgactcagccacctccatgtccgtgtccccggacagacagcctacatcacctgctctggagatgtatgactaacgagtatggttcctggtatcagcagaaggcaggccagccccctgtcctactcatctttacaaatccaggcgccctcgtcggggtccctgacgcgtacttccgtccggccctcccgacctcgtacggggaacacgagtccactctacgaccagtcgacggcccggggaacccaggtcccttaagtcggatggacggtctggttcctacgttcgtcgttcgagggtcggttacggggaacaacgacggtcggttcggcggtttcggttccgggggacggggtaacggggaccctagggttccgtacgggtacccgttcggttaacggtccgaacggtccccgaagggtcccgtccggccccccgtaggtccctaccggttcttcccgtcccctacccttcccg

SEQ ID NO: 367293 - DNA, 567 bp, Homo sapiens
  misc_feature: GZ8MTXP02JICVG.13.9.A09.1.454.CMB.2.raw
  modified_base (190)..(190): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttctggtatcagcagaaggcaggccacgccccctgtccctactcatctttacaaaatccaggccgccctcgtcggggtccctggacgcgtattccgccccggctccgcctcgtagggaaccacgcgtccactctacgaccatcgacggccgggacccacgcctattcgatgaggtctgtctacttctgtcgaggcgtagggacacgagcgtgcgtggtcggcggacggcagtcgtggtaccgttcgttacggtccgacgaccccgaacggtcccgtccggtccccccgtcgggtccctaccgttccgttcccgtttccccctaccccc

SEQ ID NO: 367294 - DNA, 544 bp, Homo sapiens
  misc_feature: GZ8MTXP02HA376.13.9.A09.1.454.CMB.2.raw
  modified_base (190)..(190): a, c, t, g, unknown or other
  modified_base (327)..(327): a, c, t, g, unknown or other
  modified_base (354)..(354): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtattgactaacgagtatggttcctggtatcagcagaaggcaggccagccccctgtcctactcatctttacaaataccaggcgccctctggggtccctgagcgattcnccccggctccgcctcgtcgggaacacngtcactctgaccatcacgcggacccagcctattgagtgaggctgtctacttctgtcaggcgtgggacaacgagcgtgcgtggtcggcgggagggaccaggtcgtcgaccggttcttaacgggtccacggcccgaacggtcctccggccccccgttcggtcccaccgttcccgttcgttccccctaccccg

SEQ ID NO: 367295 - DNA, 530 bp, Homo sapiens
  misc_feature: GZ8MTXP02G360S.13.9.A09.1.454.CMB.2.raw
  modified_base (190)..(190): a, c, t, g, unknown or other
  modified_base (217)..(217): a, c, t, g, unknown or other
  modified_base (335)..(335): a, c, t, g, unknown or other
  modified_base (361)..(361): a, c, t, g, unknown or other
  modified_base (413)..(413): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctgganatgtattgactaacgagtatggttctggtatcagcagaaggcaggccacgccccctgtcctactcatcctttacaaaataccaggccggtccctcgtcggggtccctggagcgattcnccccggctccgcctctgggaacacgngtcactcctgacccatcacgcggacccagccctatgatgagctgtctattcngtcaggcgtggacacgagcgtgcgtgtcggcggagggccagtcgcgtaccgtcgttagggctacgaccccgaaggccgtcgcccccgtcggtccaccgtctccgtttccccgccccc

SEQ ID NO: 367296 - DNA, 537 bp, Homo sapiens
  misc_feature: GZ8MTXP02IXY64.13.9.A09.1.454.CMB.2.raw
  modified_base (218)..(218): a, c, t, g, unknown or other
  modified_base (365)..(365): a, c, t, g, unknown or other
  modified_base (477)..(477): a, c, t, g, unknown or other
  modified_base (481)..(481): a, c, t, g, unknown or other
  modified_base (507)..(507): a, c, t, g, unknown or other
tcagtcacgtactacacgaccggtgctcgatttagcgagacgcgcaggggctgggcctaaggaggcagcatcggaggtgcctcagccatggcatggatccctctcttcctcggcgtccttgcttactgcacagaatccatggcctcctatgagttgactcagcccaccctccatgtccgtgtcccccggacagacagcctacatcacctgctctgganatgtattgactaacgagtatggttcctggtatcagcagaaggcaggccacgccccctgtccctactcattctttacaaaatccaggccgccctcgtcggggtccctggacgcgtattctcgtcggcctccaactctagggaaccacngtccactcctgaccatcgacgcccgggacccagccctagttgatggacggtctgtcttacttcgtgtccgagggcgtagggacacgagccgtgcgtggtcggcggaggaccngtcncgccgtcgttaggcacgcccgagccnccgccccgtcgtcacctctccgtccctccc

SEQ ID NO: 367297 - DNA, 582 bp, Homo sapiens
  misc_feature: GZ8MTXP02FJ3JF.13.9.A09.1.454.CMB.2.raw
tcagtcacgtactacacgaccggtgctcgatttagcgagacgcgcaggggctgggcctcaggaggcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatatacttctggtatcagcagaagtcaggccagtcccctgtgctggtcatctatcaagatgccaaggccggccctgacggggactccccccgtgacgcgtattctcgtcggcctacccaacttcgtaggggaacctcgacgcccactctacgacccatccgacggccgggaccccagggcctagacggagtggaggtctagtacttatttacgtgtaccgagggcggtagggacagacagccacgtcgcccgtactacgttcggttaccgttacgggaaccgttcggggaaacccgtaacggtacccgtaacccggttacccgttaaaacggtcccgaaaaacgcccccgg

SEQ ID NO: 367298 - DNA, 708 bp, Homo sapiens
  misc_feature: GZ8MTXP02IR07Q.13.9.A09.1.454.CMB.2.raw
  modified_base (192)..(192): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtcccttgcttactgcacagaatccatggcctcctatgagttgactcagccaccctcatgtcccgtcgtcccccgganagacagcctacatcacctgctcgtggagtatgttattgaacttaacgagttattcggttcctaggtatcgagcaaggaaggcacggcccaccgccccctgtcccctactcatttacttacaaatccgaggccgtccctcggtcgggtccctgacgtctacttccgtccccggcctcccgcctacggtacggaaaccacgtcgtacctacctcgtaccgaccctagtccggaccggacccggggacccacggtacctagttcgagtggtacggtcttcgttaccttaccgttcgtcggtacggtacgggtacgggtacgggaacctaacggcggtcggtgttccggttcgggttcggggaccggggtaacgggtaccgtacggttaccggtacggttacccggttacggtttaaccgggaccgaacccgggtacccgtaacggtcccgttccccgggtccccccgttacggttaccccttaccgttacccccgtttcccggttaccccccttacccg

SEQ ID NO: 367299 - DNA, 535 bp, Homo sapiens
  misc_feature: GZ8MTXP02GXOH7.13.9.A09.1.454.CMB.2.raw
  modified_base (275)..(275): a, c, t, g, unknown or other
  modified_base (297)..(297): a, c, t, g, unknown or other
  modified_base (340)..(340): a, c, t, g, unknown or other
  modified_base (347)..(347): a, c, t, g, unknown or other
  modified_base (436)..(436): a, c, t, g, unknown or other
  modified_base (442)..(442): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgctattttaaaaggtgtccaatgtgagctgcagctgggtggagtctgggggaggtttggtacagccaggggcggtccctgagactctcctgtataacttctggattcaacttggggtnattatgctatgaactgggtccncaggctccgagggagggctggagtggggtagtttcagttaggncaattcncatgatgggaacaacagaatacgcgcgtctagtaaaagcagattcaccatctacaaagagatagagtaccaagaagcatccgtcctttntgcagntagagtagcctaggaacgaccgaggacacgagccatctaattactgtgctagatagtatgctaagtcctacgtactgactaggtcgggggtcc

SEQ ID NO: 367300 - DNA, 541 bp, Homo sapiens
  misc_feature: GZ8MTXP02GGBYR.13.9.A09.1.454.CMB.2.raw
  modified_base (219)..(219): a, c, t, g, unknown or other
  modified_base (364)..(364): a, c, t, g, unknown or other
  modified_base (466)..(466): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtcgtccccccggacagacagcctacatcacctgctctgganatgtattgactaacgagtatggttctggtatcagcagaagcaggccacgccccctgtcctactcattctttacaaaatccaggccgcccctcgtcgggtcccctgacgcgtattccgtccccggcctccgctcgtcgggaacacngtcactctcgaccatcgagccggacccagcctatgatgagctgtctactctgtcgaggtcgtagggacaacgagcgtgcgtggtcggcgggacggcaggtcncggtaccgtcgtaggtccgacgtacccgaaggccgtccgtcccccgtcggtccacgtctccggtccccgtccccg

SEQ ID NO: 367301 - DNA, 643 bp, Homo sapiens
  misc_feature: GZ8MTXP02HEOH6.13.9.A09.1.454.CMB.2.raw
  modified_base (190)..(190): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctggagatgtatgactaacgagtatggttcctggtatcagcagaaggcaggccacgccccctgtccctactcattctttacaaaactccgaggccggccctcgacgggactccccgtgagcgtattccctcgtcgcctacctaacgtctacgggacctcaacgccctactctcgaccactcacggccggacccagggcctagtggtacgtggaggtactgtaaccttaagttaccgtgtaccggtagggtccggtggggaaccaggaccgaagtccgaccgttcggacccccgtattaggttacggttccgttaccggggtaaccgttacggggaaaccctaacgggtaccccgtaacccggttacccgtaacggggttcccaaaccggaccccgtaaccgggacccccctaaaccccggtacctttacccg

SEQ ID NO: 367302 - DNA, 624 bp, Homo sapiens
  misc_feature: GZ8MTXP02F7AEY.13.9.A09.1.454.CMB.2.raw
  modified_base (378)..(378): a, c, t, g, unknown or other
  modified_base (602)..(602): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccggacacgacagcctacatcacctgctcgtggagatgtatgaactaacgagtatggttctggtatcagcaaggaaggcacggccacgccccctgtcctactcattctttacaaactccaggccggccctcgtcggggtccctggacgtcgtacttccgtccccggcctcccgccttcggtacgggaaaccncgtacggtccaacgtctaccgaccctagtccgacgggacccggaacccacgtcccgtaattggaacgtggacggtcttcggttccttacgttcgttggttccgacgggtcggtacgggaaccaaacgcgcggttgcgtttcgggtaccgggcgggtacggaccgtggtcgtcggtaccgtcgttacggccgacgacccgtaggcctccgtcccccgtgtacccncgttccgtccgttcccgtcccg

SEQ ID NO: 367303 - DNA, 679 bp, Homo sapiens
  misc_feature: GZ8MTXP02GO9TH.13.9.A09.1.454.CMB.2.raw
tcagtcacgtactacacgaccggtgctcgatttagcgagacgcgcaggggctgggcctcaggaggcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggattatttgttgaggatagatatgcttgttggtatcaacagaagccggcagtcactacattgttatctatgaagacacgaagccggacccctacgagggactcccctagagcgtattccctctacggctaccaacttcgacgggaaccacgacacccgaacttccgtacgaaccataccgaaggacccgggaccccaagcccgtaagtagggacttacgggaacgtcctacggtaacttaaagtttacccgtaggttaaccctaattaccgtaagttaacggggaaacctaaacggtaatttaacggttaggggtaagttacggggtacgttcggggtttaccggggaccggggtaaaacggggaacccgtaaaacggttcggtaacccccggtacgttacgggaccgaaccggtaccccgaaacggggccctacccggtccccctcggggttacccgtaacccg

SEQ ID NO: 367304 - DNA, 645 bp, Homo sapiens
  misc_feature: GZ8MTXP02GPGQB.13.9.A09.1.454.CMB.2.raw
  modified_base (272)..(272): a, c, t, g, unknown or other
  modified_base (296)..(296): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgcttattttaaaaggtgtccaatgttagctgcagctggtggagtcgtgggggagttggtacagccagggcgtccctgagactctcctgtactaacttctggattcaacttgggtnattatgcttatgaacgtgggtccnccaggctcgaggggagggctggagtgggtaggtttcagttaggagctaattcacatgagtgggaacaaagagaactacgccgcgtactaggtaaaacggcagtacttaccaaccctattcctacgaaaaggagtaagtagaaacgtacccaaaggaaacgacctaactcccggtaccttttccgtgaccgagtaatggaagttacgccgtaggaaacggaccgaacggaaccaacgacgtaccattacctaagttacgtggtacgtagttaaacggagttaacgttagttacggactacgtaaccgtaccgtaccgttggaccgtaggtcgggggtaccctttcggggg

SEQ ID NO: 367305 - DNA, 654 bp, Homo sapiens
  misc_feature: GZ8MTXP02J3YIZ.13.9.A09.1.454.CMB.2.raw
  modified_base (193)..(193): a, c, t, g, unknown or other
  modified_base (217)..(217): a, c, t, g, unknown or other
  modified_base (254)..(254): a, c, t, g, unknown or other
  modified_base (540)..(540): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagcccaccctccatcgtccgtcgtcccccgganagacagcctacatcacctgctcgnggagatgtattgactaacgagtagtggttcctggtancagcagaaggcacggccacgccccctgtcctactcacttctttacaaaactccgacggccgtcccctcgtcggggtccctagacgtcgtacttccgtccccggcctccgccgtacgtcggaaccacgtcgtctaaccgtccagacccgaagtccgacgggacccgggaacccacgtcccgttagtcgagtggacgtcttcgtaccgttcgttctcggttcgacgggcggtacggaacaacgcggtcgtacgtccggtcgggttcgggggaccggtacgggtaaccncggttaccgtacggacccggttacggtacggtaccgaccgacccggtaaccgtcccgtaaccccggtcccccgtcggtccctacccgttcccgtacccgttaccccctcccccg

SEQ ID NO: 367306 - DNA, 538 bp, Homo sapiens
  misc_feature: GZ8MTXP02JDMZA.13.9.A09.1.454.CMB.2.raw
  modified_base (190)..(190): a, c, t, g, unknown or other
  modified_base (217)..(217): a, c, t, g, unknown or other
  modified_base (331)..(331): a, c, t, g, unknown or other
  modified_base (354)..(354): a, c, t, g, unknown or other
  modified_base (357)..(357): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagcctacatcacctgctctgganatgtattgactaacgagtatggtcctggtatcagcagaaggcaggccacgccccctgtccctactcatctttacaaaatccaggcggccctcgtggggtccctgagcgattccnccccggctcccgcctctggaacncgngtcactctcgaccatcacgcggacccagcctatgatgagctgtctactctgtcaggcgtgggacaacgagcgtgcgtggttcggcggagggaccgtagtccgtgaccgttcgtaacggtcgacgacccaagggtcctccgtcccccgtacggtcctacgtccttaccgttacccctacccg

SEQ ID NO: 367307 - DNA, 616 bp, Homo sapiens
  misc_feature: GZ8MTXP02H7VTA.13.9.A09.1.454.CMB.2.raw
  modified_base (190)..(190): a, c, t, g, unknown or other
  modified_base (336)..(336): a, c, t, g, unknown or other
  modified_base (588)..(588): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctctatgagttgactcagccaccctcatcgtccgtcgtcccccgganagacacgcctacatcacctgctcgtggatatgtatgactaacgagtatcggttctggtatcgagcagaggcacggccacgtccccctgtccctatctactttaccttaacaaaactccgacggccgtcccgtcggtcggggtcccnggacgtcgtacgttccgtcccccggcctcccgcctcggtacgggaaccacgtcgtctaactccgtacgacctacgcgacggacccgggaccacgtaccttagtgagtggacgtcttcgtaccttcttgacgtcgagggtcgtaggacagtgcgtcgcgtcggtacgggcggtacggacgtagttccgtacggtccgtacgttacggacaccgacccgtacggtcccgtaacccggtccccgtacggttcccnccgtttccgtcccggtttcccctccccg

SEQ ID NO: 367308 - DNA, 536 bp, Homo sapiens
  misc_feature: GZ8MTXP02F5U80.13.9.A09.1.454.CMB.2.raw
  modified_base (188)..(188): a, c, t, g, unknown or other
  modified_base (330)..(330): a, c, t, g, unknown or other
  modified_base (354)..(354): a, c, t, g, unknown or other
  modified_base (365)..(365): a, c, t, g, unknown or other
  modified_base (429)..(429): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccacctccatgtccgtgtccccgganagacagcctacatcacctgctctggagatgtattgactaagagtatggttcctggtatcagcagaaggcaggccacgccccctgtcctactcatctttacaaaatccaggccggccctgtcggggtccctgagcgtattccnccccggctccgactcgtggaaccncagtcacttcngacccatcgagccggaccctagcctatgatgagtctgtctactctgtcaggcgtggacaacggngcgtgcgtggtcggcggacggactcgtcgtcggtacgttcgtacggtacgacgacccgagtccgtcccgtccccgtacggtcctacgttccgtccgttaccctcccg

SEQ ID NO: 367309 - DNA, 638 bp, Homo sapiens
  misc_feature: GZ8MTXP02HCRRH.13.9.A09.1.454.CMB.2.raw
  modified_base (221)..(221): a, c, t, g, unknown or other
  modified_base (472)..(472): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtcccgtcgtcccccggacagacacgcctacatccacctgctctgganatgtattgactaacggagtatggttcctggtatcagcagaaggcaggccacgccccctgtccctactctacttctttacaaaactaccgaggccgtccctcgtcggggtccctgacgcgtacttccgccccggtcctcccgccgtcgtacgggaaccacgtcgtacctactcgtacgaccctagtccgacggacccgggacccacgtcctagttcgagtcggacggcttcgtcttacttccgtggtaccgngggtcggtagggaacaacgacggtcggtggtccgttgggttaccggggcgggtacgggtaccgtaggttccgtaggtacccggttcgttacggcaccggccgtaacggcccgtccggtcccccgttacggtccctaccgttcccgttcccgttaccccctaccccg

SEQ ID NO: 367310 - DNA, 543 bp, Homo sapiens
  misc_feature: GZ8MTXP02ICPFC.13.9.A09.1.454.CMB.2.raw
  modified_base (189)..(189): a, c, t, g, unknown or other
  modified_base (232)..(232): a, c, t, g, unknown or other
tcagtcacgtactacacgaccggtgctcgatttagcgagacgcgcaggggctgggcctaaggaggcagcatcggaggtgcctcagccatggcatggatccctctcttcctcggcgtccttgcttactgcacagaatccatggcctcctatgagttgactcagccaccctcatgtccgtgtcccccgganagacagcctacatcacctgctctggagatgtattgactaacgngtatggttcctggtatcagcagaaggcaggccagccccctgtcctactcatctttacaaaatccaggcgccctcgtggggtccctgagcgtattccgtccggccctcccgcctcgtcggggaacacgacgtccaactctacgaccatcgacgcccgggacccagcccttagttcgagtgaggctgtctacttctgtcgaggtcgtagggacacgagcgtgccgtggtcgggcggacggcgagtctcgaccgttgtacggtcacgcccgaaggcctccgcccccgtggtccactctccgtccccaccctccg

SEQ ID NO: 367311 - DNA, 650 bp, Homo sapiens
  misc_feature: GZ8MTXP02GDQK2.13.9.A09.1.454.CMB.2.raw
  modified_base (194)..(194): a, c, t, g, unknown or other
  modified_base (222)..(222): a, c, t, g, unknown or other
  modified_base (253)..(253): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacagcctacatccacctgctctgganatgtattgaactaagagtatggttctggtancagcagaaggcaggccacgccccctgtccctactcacttacctttaacaaaactccgacggccggtccccttcgtcggggtcccctggacgtcgtacttccgccccggcctcccgcctcgtacgggaaccacgcgtccactcctacgaccctagtcgaacgggcccgggacccaacggtccctaagttgacgttggacggttcttacgttaccttaccgtttcgtacggttcgacggggtcggtacgggaaccaaacggcggtcgtcggtcgttggggttccgggacgggtaacgggtaccgtacggtcgtcggtacccggttgttacgggcaccgaccgtacggcctaacccgtcccccgtacggtcctaccgttcccgtccgttaccccctcccg

SEQ ID NO: 367312 - DNA, 630 bp, Homo sapiens
  misc_feature: GZ8MTXP02G3784.13.9.A09.1.454.CMB.2.raw
  modified_base (257)..(257): a, c, t, g, unknown or other
  modified_base (274)..(274): a, c, t, g, unknown or other
  modified_base (279)..(279): a, c, t, g, unknown or other
  modified_base (296)..(296): a, c, t, g, unknown or other
  modified_base (469)..(469): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgcttattttaaaaggtgtccaatgtgagctgcagctggtggagtcgtgggggaggtttggtacagccagggcggtccctgagactctcctgtataacttntgattcaacttggggtnattangctatgaactgggtccnccaggcctccgaggggaggggctgggagtggggtaggtttcagttaggagctaatttctacatgagtggggaacaacgagaataccgccgtcgtactaggtaaaaggctaagtattccaaccatctacaaagagatggacgtaccgaagaacgctaactccgtccttttacgngactagtgtaggagtacgccgtaaggaaaccgaaccggaggaaccaacgacgacctaacgttaccttaactttacgtaggttgaacgtaaggaacgtacgttacgttacgacgtaacgttaccctaaccggtacctgtacggttacgggtcgggggttccg

SEQ ID NO: 367313 - DNA, 629 bp, Homo sapiens
  misc_feature: GZ8MTXP02I7P4S.13.9.A09.1.454.CMB.2.raw
  modified_base (194)..(194): a, c, t, g, unknown or other
  modified_base (222)..(222): a, c, t, g, unknown or other
  modified_base (236)..(236): a, c, t, g, unknown or other
  modified_base (250)..(251): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacagcctacatcacctgctcgtgganatgtatgactaagngtatggtctggtannagcagagcaggccacgccccctgtcctactctacttctttaacaaactcccgaggccgtccccttcggtcggggtcccctggacgtccgtactttccgtccccgggccctcccggccttcggtacgggaaaccacgacggtccaccttctacgaccagtccgacgggcccgggacccacgtccttagttgaacgttggacggtcttcgttacctacgttctacggttccgagggtccggtagggaaccaacggcggtcgtggtcgttcggggttccggacgggtaacggggcctaggtccgtcggtaccgtcgttacggacacgacccgaggcccgtcccgtccccgtcggtcctccttccgtccgttcccccgtccc

SEQ ID NO: 367314 - DNA, 705 bp, Homo sapiens
  misc_feature: GZ8MTXP02JT8SZ.13.9.A09.1.454.CMB.2.raw
  modified_base (192)..(192): a, c, t, g, unknown or other
  modified_base (220)..(220): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagcccaccctccatgtccgtcgtcccccgganagacagcctacatccacctgctctgganatgtatgactaacgagtatggtctggtatcagcagaagcgaggccacgccccctgtacctactctattctttaacaaaactccgacggccgtccctcgtcggggtccctgacgctacgttccgccccggtcctccgtcctacgtagggaaccacgtacgtccacttccgtacgaacctacgtccgacggggacccgggtaaccccgacgtacccgttaacgttaggaacgttaggtcgggtacgtttaccggttacctttaccgtttcgtcggttaccggtaacggggtcgggttacggggaacctaaacgggacggtcggttcggtacggttcggggttaccggggacgggggaacgggtaccgtacggttccggtacggtacccggttcggttaaccgggtccgaccggcccggtaacggtccgtcccgtccccccgtcggggttaccctcccgttcccggttcccgttcccccggttccccg

SEQ ID NO: 367315 - DNA, 611 bp, Homo sapiens
  misc_feature: GZ8MTXP02IK07T.13.9.A09.1.454.CMB.2.raw
  modified_base (213)..(213): a, c, t, g, unknown or other
  modified_base (218)..(218): a, c, t, g, unknown or other
  modified_base (372)..(372): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtcccgtcgtcccccggacagacagcctacatcacctgctntggantgtattgactaacgagtatggttctggtatcagcaagagcaggccacgcccctgtcctactcattctttacaaaactccgaggccgtccctcgtcggggtccctggacgcgtacttccgtccccggcctacccggccttcgtacggggaaaccncgagtccacctcgtacgaccctagtcgacggcccgggaccacgtcctagtcgagtgacggtcttcgtacctacttctgtcgaggtcggtaggaacaacgacgtcgtagtcgttcgggttacgggcgggaaggaccgacgttcgtacggtaccgttcggtttaaacggccgaccgaccgtacggtccgtaacccggtcccccgttcggtaccctacgttccgttccttcccccgtacccg

SEQ ID NO: 367316 - DNA, 534 bp, Homo sapiens
  misc_feature: GZ8MTXP02FHA5F.13.9.A09.1.454.CMB.2.raw
  modified_base (191)..(191): a, c, t, g, unknown or other
  modified_base (202)..(202): a, c, t, g, unknown or other
  modified_base (218)..(218): a, c, t, g, unknown or other
  modified_base (333)..(333): a, c, t, g, unknown or other
  modified_base (357)..(357): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtccccccgganagacagcctanatcacctgctctgganatgtatgactaacgagtatggttcctggtatcagcagaaggcaggccagccccctgtcctactcatctttacaaaataccaggccggcccctctcggggtcccctgagcgattcnccccggctccgctctgggaacacngtccactctgaccatccagccgggacccagccctaatgatgacggtctgtctacttctgtcaggcgtgggacaacgagccgtgctggttcggcggaggggccaggtctcgaccgttcgtaggtcacgtccccaaggcctcggcccccgtcggtccaccgtcgtccgtccccgtcccc

SEQ ID NO: 367317 - DNA, 578 bp, Homo sapiens
  misc_feature: GZ8MTXP02GJW5C.13.9.A09.1.454.CMB.2.raw
  modified_base (189)..(189): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccacctccatgtccgtgtcccccgganagacagcctacatccacctgctctggagatgtatgaactaacgagtatggttcctggtatcgagcagaaggcaggccagccccctgtcctactcatctttacaaataccaggccgccctcgtcggggtccctgacgcgtacttccgtccccggtcctcccgacctccgtacggggaaaccacgtgtccactctacgacccatccaggccgggacccagccctatcgattggagtctcgtcttacgtcttagtcgaggtcggtaggacaacgacgcggtgcgttcgggtcggccgggaagggaccgtgtaccgtacggacccgttcgtacggtaccacgaccgaacggcgtccgccccgtcggtcctacctccgtccgtcccgtcccccg

SEQ ID NO: 367318 - DNA, 711 bp, Homo sapiens
  misc_feature: GZ8MTXP02FSMJT.13.9.A09.1.454.CMB.2.raw
  modified_base (218)..(218): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtcgtcccccggacagacagcctacatcacctgctctggantgtatgactaagagtatggtctggtatcagcagaaggcaggccacgccccctgtccctatcatctttacaaaatccaggccgccctcgtcggggtccctgacgcgtacttccgccccggcctcccgctcgtaggggaaccacgtcgtcacttcgtacgaccctaagtccgacgggacccggggaccccacgtcccgttagttggaacttcgggacggtcgttcggttaccttaccgttcgttacggttccggaacgggtccgggttacggggaacctaaaacgggacggtcccggtaggtccggttcggggtttcccgggggacgggggtaaaccgggggacccgtaacgggttccggttaccggtacccggtttaccggtttaaacggggttcccgaccggttaaccccggaaccgggtaccccgttccccggtccccccgttcgggttaccctaccccgtttccgtccccggttttcccccggtccccccg

SEQ ID NO: 367319 - DNA, 750 bp, Homo sapiens
  misc_feature: GZ8MTXP02JW0MU.13.9.A09.1.454.CMB.2.raw
  modified_base (192)..(192): a, c, t, g, unknown or other
  modified_base (219)..(219): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatcgtccgtcgtcccccgganagacagcctacatcacctgctctgganatgtattgactaacgagtatggttctggtatcagcagagcacggccacgccccctgtacctactcattcctttaacaaaatacccgagggtcccgtaccccttcggtcgggggttccccctaggaacggtccgtaacgtttcccgcccccccggtcccgtttcccccgcccgtttaccgggacggggaaacccacgtacggttaccaaccttccgtacgaaccctagtccgaaccgggtacccggggaacccctacggtacccttaagttcggaagttgggacggtccgttacggttacccttactttccgtaggttcgtaacggggccggttaggggaactaaccgggagtacccgttgggtcgttcggggttccgggaccgggggtaacgggacccgtaacgggttccgtaccgggtaccggtttaccgtttacgggtaccgaccgggtaccccgaacgggttcccccgtccccggtaccccgttaccgtacccgtacccgttcccgttaccccgtaccccctaccccg

SEQ ID NO: 367320 - DNA, 579 bp, Homo sapiens
  misc_feature: GZ8MTXP02FYGBT.13.9.A09.1.454.CMB.2.raw
  modified_base (218)..(218): a, c, t, g, unknown or other
  modified_base (233)..(233): a, c, t, g, unknown or other
  modified_base (366)..(366): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagntgtattgactaacgngtatggtcctggtatcagcagaggcaggccacgccccctgtcctactcattctttacaaaactccgaggccgccctcgtcggggtccctgacgcgtacttccgtccccggcctcccgcctcgtacgggaaccncgtagtccactcgtcgacctatccgacggcccggaccacgtcctagtgagtgacgtctgtcctacttctgtcgagggcgtgggacacgagtcgtgtcgtgggtcgggcggtacggccgtagtcgtcgtaccgttcgttacggtaccacggtaccccgaaggtccctccggtcccccgttcggtacctccgttccgtccgtcccccttaccccg

SEQ ID NO: 367321 - DNA, 681 bp, Homo sapiens
  misc_feature: GZ8MTXP02H0Y1I.13.9.A09.1.454.CMB.2.raw
  modified_base (195)..(195): a, c, t, g, unknown or other
  modified_base (222)..(222): a, c, t, g, unknown or other
  modified_base (237)..(237): a, c, t, g, unknown or other
  modified_base (247)..(247): a, c, t, g, unknown or other
tcagtcacgtactacacgaccggtgctcgatttagcgagacgcgcagggggctgggcctcaggaggcagcatcggaggtgcctcagccatggcatggatccctctcttcctcggcgtccttgcttactgcacagaatccatggcctcctatgagttgactcagcccaccctccatcgtcccgtcgtcccccgganagacagcctacatcacctgctctgganatgtatgactaacgngtatggttcnggtatcagcagaggcaggccacgccccctgtccctactcattctttacaaaaactccgaggccgtccctcggtcggggtccctggacgtcgtacttccgtccccggcctccccgtccgtcgtacgggaaccacgtacgtccacttccgtacgaaccctagtccaacggggcccggacccacgtcccttagtgagtgacggtcttcgtccttacttcgttacggtcgtacggggtacgggtacgggaaaccaagggacgtcggtacggtcggtttcggggtaccggggacggggaacgggggtaccctaggttcccggtacggtacccggttacggtttaacggggaccgtaaccggaccccggttaacgggcccttccccgggtcccccgttacggtccttacctttcccgttacccgtttacccccctccccg

SEQ ID NO: 367322 - DNA, 631 bp, Homo sapiens
  misc_feature: GZ8MTXP02HQB3P.13.9.A09.1.454.CMB.2.raw
  modified_base (190)..(190): a, c, t, g, unknown or other
  modified_base (203)..(203): a, c, t, g, unknown or other
  modified_base (218)..(218): a, c, t, g, unknown or other
  modified_base (230)..(230): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctctatgagttgactcagccaccctccatcgtccgtcgtccccgganagacacgcctacntcacctgctctggantgtatgactagngtatggttctgtatcagcagagcacggccacgccccctgtcctactctattacctttacaaaactccgacggccgccctcggtcggggtccctggacgccgtacttccgccccggtcctccgcctacggtacggaaacctcgtcgtctaaccgtcctacgacctagccgacggacccggacccacgtcctagttgagtcggacgtcttcgttccttacgttcgtcggttcgtacgggtcgggttacgggaacgaacgacggtcgtcggtcggttgggttccggggacgggtacggggaccgtacggtccgtacggttccggttacgttcggtaccgaccgacccgaacggtccgtcccgtccccgtcggtcctccgttccctcccggtttccccgtccccg

SEQ ID NO: 367323 - DNA, 583 bp, Homo sapiens
  misc_feature: GZ8MTXP02JV8HG.13.9.A09.1.454.CMB.2.raw
  modified_base (275)..(275): a, c, t, g, unknown or other
  modified_base (295)..(295): a, c, t, g, unknown or other
  modified_base (336)..(336): a, c, t, g, unknown or other
  modified_base (342)..(342): a, c, t, g, unknown or other
  modified_base (390)..(390): a, c, t, g, unknown or other
  modified_base (439)..(439): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggcttacttgggttttccttgttgcttattttaaaaggtgtccaatgtgagctgcagctggtggagtcgtgggggaggtttggtacagccaggggcggtccctgagactctcctgtataacttctggattcaattggggtnattatgctatgactggtccncaggctcgagggaggctggagtgggtagttcagttaggagnaattcnatgagtggacaacagaatcgcgtctcagaaagcagattccacatctanaagagatgacgtcaagaagcaacgtcgacccttttgacgcctaaaggtntaggagtacgaccgtagggaaaccgaccggaaggtaccaacgaccgacctaagttaccttaattcgtacgtgacgtaaggagtacgttacgtacgacctaacgttcccgtaacgtaccgtggtaccggttagggtcggggtccg

SEQ ID NO: 367324 - DNA, 668 bp, Homo sapiens
  misc_feature: GZ8MTXP02JT77Q.13.9.A09.1.454.CMB.2.raw
  modified_base (279)..(279): a, c, t, g, unknown or other
  modified_base (303)..(303): a, c, t, g, unknown or other
  modified_base (324)..(324): a, c, t, g, unknown or other
  modified_base (337)..(337): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttggcttacttgggttttcctgttgctattttaaaaggtgtccaatgtgagctgcagctggtggagtcgtgggggaggtttggtacaggccgaggggccggtccctgacgacctctcctgtataacttctaggattcaacttggggtntattatgctagtgacgtgggtccncaggctcgaggggaggctggngtgggttagtttnagtttaggatctaaatttctacagttggaagtcggggaaactaacgagtaactaccgggcccgtcgttacgtaacggtaaaaagggcctaaaggtactttaccaaccaattcccgtaaagaaaggtaagtagttacggaggtacccaaaggaaccgtacacgtacccggttccttttacgcgtaccttaaggagttaggacgttacgcccgtaggaaaccgacgaaacggacaacggacgtacctaatactacgtttacgaggtcgttacgagtaagtacggttatggactaacggttcctaaccgactcgtacgtcggcgggggtttccg

SEQ ID NO: 367325 - DNA, 568 bp, Homo sapiens
  misc_feature: GZ8MTXP02IQDIS.13.9.A09.1.454.CMB.2.raw
  modified_base (378)..(378): a, c, t, g, unknown or other
  modified_base (414)..(414): a, c, t, g, unknown or other
  modified_base (498)..(498): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccacccctccatgtcccgtcgtcccccggacagacagcctacatcacctgctctggagatgtattgactaaacgagttatggttcctggtatcagcagaaggcaggccacgccccctgtccctactcattctttacaaaatcccaggccgcccctcgtcggggtcccctgacgcgtattccgtccccggcctcccgcctcgtcggggaaaccacgngtccactctacaccctatcgaacgcccggggacccncggtacctagtgagtagaggtctgttctacttcgtgtcgagggtcgtcgggacacgagcgtgcgtgtcggcggtaggcaggtcngtaccgtcgttaacggcacgtaccgaagccctcggcccccgtggtccaccttccgtccgttcccgtcccg

SEQ ID NO: 367326 - DNA, 629 bp, Homo sapiens
  misc_feature: GZ8MTXP02JUJYY.13.9.A09.1.454.CMB.2.raw
  modified_base (218)..(218): a, c, t, g, unknown or other
  modified_base (376)..(376): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatcgtccgtcgtccccggacagacacgcctacatcacctgctctgganatgtatgactaacgagtatcgttctggtatcagcgagaggcaggccacgcccctgtcctactctacttacttaacaaactaccgacggccggtcccgttcgtaccggggtcctaggacgtcgtacttccgtccccggcctccgcctcgtacggaaccncgtcgtccactccgtacgacctataccgacgggcccggacccacggtacctagtacgagtgacgtcttcgtacttacgttcgtgtcgtagggacgtagggacaacggtcgcggtgtcggttcgggtccgggacgggtacgggtaacgtcggtacgtacggtaccgttacgttacggtacgaccgacccgtaccggtccgtaaccgtcccccgtacggtacctaccgtccgtttccccgtacccgttacccccg

SEQ ID NO: 367327 - DNA, 714 bp, Homo sapiens
  misc_feature: GZ8MTXP02GURUC.13.9.A09.1.454.CMB.2.raw
  modified_base (221)..(221): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtcccgtcgtcccccggacacgacacgcctacatcacctgctctgganatgtattgactaacgagtatggttctggtatcgagcagagcacggccacgccccctgtccctactcacttctttaacaaatcccgaggtccgcccctcgtcggggtccctgacgcgtacttccgccccggcctcccgccgtcgtacgggaaccacgtcgtaccactccgtacgaccctagtccgacgggcccggggaaccctacggtcccttaaggttcgaacggttcggaacggggttccttacgttaccgtttaccgtttcgttacggtaccggtaacggggtccggttaacggggaacctaacgggtacggtcgtcgggtaccggtttcgggttaccgggggcgggtaacggggtacccgtacggttaccggtacggtacccggtttacgtttaaccggggccctaaccggaccccgtaacggtccccgttaacccggccccccgttcggtaccctcccgtttccgttccccgttacccccttacccccg

SEQ ID NO: 367328 - DNA, 636 bp, Homo sapiens
  misc_feature: GZ8MTXP02FX2PZ.13.9.A09.1.454.CMB.2.raw
  modified_base (270)..(270): a, c, t, g, unknown or other
  modified_base (294)..(294): a, c, t, g, unknown or other
  modified_base (313)..(313): a, c, t, g, unknown or other
  modified_base (338)..(338): a, c, t, g, unknown or other
  modified_base (346)..(346): a, c, t, g, unknown or other
  modified_base (361)..(361): a, c, t, g, unknown or other
  modified_base (464)..(464): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttggcttacttgggttttccttgttgcttattttaaaaggtgtccaatgtgagctgcagctggtggagtcgtgggggaggtttggacagccagggccgtcctgagctctcctgtatacttctggattcaagttggggtntattatgctatgaacgtgggtccncaggctccgaggggagggntgggagtgggttagttcagttaggntatattcnagtgagtggaacaanagaactccgcgtcgttactaaggtaaaacgcaagtacttaccgaacctagttcaaacgaaggactagtagtacgacaagaacgtcacgttcgttccctttganactaggtataggtaacggtacgtacccggaaggaaaaccggacccggtaaggaacctacgacgacccttagttaccttaaattcgttgactacgtaaggtacgttagttacgtctaaccgtaacgtacccctaacgtacccgtagtacccggtggggttacggggtttccgg

SEQ ID NO: 367329 - DNA, 635 bp, Homo sapiens
  misc_feature: GZ8MTXP02IZPRT.13.9.A09.1.454.CMB.2.raw
  modified_base (276)..(276): a, c, t, g, unknown or other
  modified_base (281)..(281): a, c, t, g, unknown or other
  modified_base (298)..(298): a, c, t, g, unknown or other
  modified_base (347)..(347): a, c, t, g, unknown or other
  modified_base (358)..(358): a, c, t, g, unknown or other
  modified_base (560)..(560): a, c, t, g, unknown or other
tcagtcacgtactacacgaccggtgctcgatttagcgagacgcgcagggggggagaggagccccagccgtgagattcccaggagtttccacttggtgatcagcactgaacacagaccaccaaccatggagtttgggctttacttgggttttccttgttgcttattttaaaggtgtccaatgtgagctgcagctggtggagtcgtgggggaggtttggtacaggccgaggggccggtccctgagactctcctgtatacttctggattcattggggtnattangctatgaactgggtccnccgaggctccgaaggggagggctgggagtggggttagtttcagttaggngctaatttcanagtgagtgggaacaacgaggaatccgccgtacgtctaaggtaaaacgctaagacttccaacctattcctaacaaagtagacttgggaacctacgaaagaaagtcctaactccgttaccctttgacgtacgtaagtacgtaggacgtaccgaccgtaaggaaccgaaccgagtaaccacgacgtcctattacgttagttacgngtacgaacgtaaggaacgtagttactcgaccgtaaccgtaccgacgtacgtcggtacgttaggggtccgggttcg

SEQ ID NO: 367330 - DNA, 586 bp, Homo sapiens
  misc_feature: GZ8MTXP02F7Y91.13.9.A09.1.454.CMB.2.raw
  modified_base (192)..(192): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagcccaccctccatgtccgtgtccccccgganagacagcctacatcacctgctctggagatgtattgactaagagtagtgttctggtatcgagcaagaggcacgccacgccccctgtcctactctatactttacaaactaccgaggccgtccctcgtcgggtccctgagcgtattcctccccggcctcccgctcgtaggaaccacacgtccaacttcacgaccatcgacgaccggacccagcctagtcatgacggctacgtctactctagcgacggtcgtacggactaaccgagtcgtcgtcgttacggttccgggcgggacgggtacccaggttaccgtcggtaccgtttccggtacggttaccgaccgaccgaaccgcgtaacccgcccctacggtccaccgttccgtcctaccccttaccccg

SEQ ID NO: 367331 - DNA, 711 bp, Homo sapiens
  misc_feature: GZ8MTXP02H7KAP.13.9.A09.1.454.CMB.2.raw
  modified_base (195)..(195): a, c, t, g, unknown or other
  modified_base (462)..(462): a, c, t, g, unknown or other
tcagtcacgtactacacgaccggtgctcgatttagcgagacgcgcagggggctgggcctcaggaggcagcatcggaggtgcctcagccatggcatggatccctctcttcctcggcgtccttgcttactgcacagaatccatcggcctcctatgtagttgactcacgccaccctcatcgtccgtccgtccccgganacgacacgcctacactcacctgctcgtaggatattgtattagtaactaacggtagttagttcggttcctggtactgagcgaagaacggcgacggccaccgcccctgtccctactctactttactttaacaaaactccgacggtacccggtccgtcgggtaccgggtccgtagacgtcgtacgttcccgtccccggcctcccgacgtcggtacggaacactcgcctactcgtacacctacgacgacggacccgccacgtactgtacgnggtagtacggtctcgttacttcgttcgtcggtacggtacggggtacggttaaggaacccgtaggtaccggtcggttaggccggttacggggtccggggacggggacgtaccggtaacggttcgtacccggttaccgtttacgttacgggacccgtaccggtaccccggtacggtccccgtaacccggtccccccggttacgggttaccccttccgtaccccgtttccccgtttacccccttaacccccg

SEQ ID NO: 367332 - DNA, 655 bp, Homo sapiens
  misc_feature: GZ8MTXP02FSJY8.13.9.A09.1.454.CMB.2.raw
  modified_base (194)..(194): a, c, t, g, unknown or other
  modified_base (222)..(222): a, c, t, g, unknown or other
  modified_base (249)..(249): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcacgcccaccctccatcgtccgtcgtcccccgganagacagcctacatccacctgctctgganatgtatgactagagtatggtctggtancagcagaagcgacggccacgccccctgtaccctactctattctttaacgaaaactccgacgggccgtccccttcggtcggggtaccctggacgtccgtattcccgtccccggtcctccccgctacggtacggaaacacgtacgtccacgtctacgaaccatccggaacggacccgggacccacggtaccctagttacgtagtcggaggtcttcgttcttacttcgttcgtacggagggtacggtacgggaacaaacgtgtccggtcggtcgttcggggttcggacgggtacgggacccgtggtaccgtcggttaccgttacggttacggtaccgaccgtacccgaacggtcccgtccggtcccccgtcggttccctcccgttccgttcccggttacccctcccccg

SEQ ID NO: 367333 - DNA, 640 bp, Homo sapiens
  misc_feature: GZ8MTXP02GO2QN.13.9.A09.1.454.CMB.2.raw
  modified_base (190)..(190): a, c, t, g, unknown or other
  modified_base (587)..(587): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtcgtcccccgganagacagcctacactcacctgctcgtggagatgtattagaactaacgtagtagttggttctggtatcagcaggaaggcacggccacgccccctgtccctactctacttactttaacaaaacgtaccgacggtccgcccgtcgtacggggtccctgacgtcgtactttccgccccgtccgtcccgtccgtacggtacgggaacctacgccgtaccactctacgacctagaccgacgggacccggtaacccacgtccttagtgagtgacggtctcgttctaccgttcgtagtcggtacgggacggtacgggaacaacggcgtcggttcgtcggttacggtcgggggaggtacgggacccgtggtacgtaccggtacgttcggtacggccgacgaacccgnggtcccgtccgtcccccgttaggtccctcgttcccttcccgtaccccttcccg

SEQ ID NO: 367334 - DNA, 607 bp, Homo sapiens
  misc_feature: GZ8MTXP02FKXHN.13.9.A09.1.454.CMB.2.raw
  modified_base (192)..(192): a, c, t, g, unknown or other
  modified_base (203)..(203): a, c, t, g, unknown or other
  modified_base (219)..(219): a, c, t, g, unknown or other
  modified_base (426)..(426): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagcccaccctccatgtcccgtgccccccgganagacagcctanatcacctgctctgganatgtatgactaacgagtatggttcctggtatcagcagaggcaggccacgccccctgcctactcatctttacaaaaatccagggtccgcccctgtcggggtccctgacgcgacttcgccccggtctcccgctcgtaggggaaaccagtacgtccaacttcgacgaccctatccgaacggccggggacccaggacctagttgatcgggngtctcgtcttacttctggtacgacggtcggtaggaacaacgacgtcgtgtcgttggtacgggacgggtacgggaccgtcggtccgtacggtaccgttcgttacggaccgtaccggtaccgaacggtccgtcccggtcccccgtaccgggtacctaccgttccgtacccgttccccgtcccg

SEQ ID NO: 367335 - DNA, 678 bp, Homo sapiens
  misc_feature: GZ8MTXP02GH1TH.13.9.A09.1.454.CMB.2.raw
  modified_base (265)..(265): a, c, t, g, unknown or other
  modified_base (281)..(281): a, c, t, g, unknown or other
  modified_base (325)..(325): a, c, t, g, unknown or other
tcagtcacgtactacacgaccggtgctcgatttagcgagacgcgcaggggggggagaggagcccccagccgtgagattcccaggagtttccacttggtgatcagcactgaacacagaccaccaaccatggagtttgggcttacttgggttttccttgttgcttattttaaaaggtgtccaatgtgagctgcagctgggtggagtcgtggggggtaggtttggtacaggccgaggggccgtccctgagactctcctgtataacttntgattcaacttgggtnattatgctagtgaacgtggtccgcgaggctccgaggggaagggntgggaggtggggttagtttcagttaggagctaatttcacagtgaagtagggaacaaacgagaaacgtcggccgtacggtactaaaggtaaagctagtacttaccacctatcgtaacaaagacgtataggacaccaaagggaaactaccgtactcccgttacccttttgaccggaataaaggtgtacggtagtaaccgaccggtaaaggaaaccggtaacccgaaggaccaaccgacgactaaacgttactaagttacgtggtacgtaacgtaaggaaacgttacgttaacgttggaccgttaaccgtaccgtttaacgaccgttcggacggtttacgggggtcccggggttcg

SEQ ID NO: 367336 - DNA, 624 bp, Homo sapiens
  misc_feature: GZ8MTXP02IB48D.13.9.A09.1.454.CMB.2.raw
  modified_base (189)..(189): a, c, t, g, unknown or other
  modified_base (194)..(194): a, c, t, g, unknown or other
  modified_base (404)..(404): a, c, t, g, unknown or other
tcagtcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctcatgtccgtcgtccccgganagacngcctacatccacctgctcgtggagatgtattgactaacgagtatggttctggtatcagcagagcaggccacgccccctgtcctactctattctttacaaaactcccgaggccggtaccctcggtcgggtccctggacgcgtacttccgtccccggacctccccgcctcggtacgggaaccacgtacgtcctacttccgtaccgtaacccncgtaccgaccggacccggaccacgtaccttagtcgagtacggacgtctcgtacttacttcgtacgtcggtacggtacggtacggaacgaacgcggtcgtcggtcggttcgggtacgggacgggacggaccgtacggttccgtacggtccgttacggtacgtaccgaccgacccgtacgtccgtccgtccccgtcgtcctccgtccctccgtaccctcccg

SEQ ID NO: 367337 - DNA, 532 bp, Homo sapiens
  misc_feature: GZ8MTXP01CWAJD.44.33.C11.1.454.CMB.2.raw
  modified_base (476)..(476): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccggcagggggtcaccatctcttgttctggaaggagtccaatatcggatcttatcctgtcaactggtatcggggactcccaggccaccggccccccgatccttatctatgctactaatcagccggccctcgagggggtcccctgcccgtattccctctggctccaagtcctggcactacaggctacctggccatccttgatctcagtctgagatgaggctgattactacgtgtgcagcagtgggatgacagccggaacggcgtgggtggttcggnggagggaacagttcgccgttcgtaaggtcaacggcccgaggcctccgccccgtcgg

SEQ ID NO: 367338 - DNA, 546 bp, Homo sapiens
  misc_feature: GZ8MTXP01D7UK3.44.33.C11.1.454.CMB.2.raw
  modified_base (540)..(540): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcgggaccccccgggcgagggggtcaccatctcttgttctggaagaagtccaatatcggatcttatcctgtcaactggtatcggggactccaggcacggccccccgatccttatctatgctactaatcagccggccctcgaggggtccctgccccgatttctctggctccaagtctcggcactacaggcctaaccctggcccatcccttgatctccagtctgagatgaggctgtattactactgtgcagcagtgggggatgacgagccggaacggcgtgggtgttcggcggagggaccaaggtcgaccgttctacggggttcacgcccgaggcttcgcccctcggtcactcttcgttccccncctccc

SEQ ID NO: 367339 - DNA, 527 bp, Homo sapiens
  misc_feature: GZ8MTXP01D1XIA.44.33.C11.1.454.CMB.2.raw
  modified_base (368)..(368): a, c, t, g, unknown or other
  modified_base (419)..(419): a, c, t, g, unknown or other
  modified_base (424)..(424): a, c, t, g, unknown or other
  modified_base (446)..(446): a, c, t, g, unknown or other
  modified_base (508)..(508): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcgggaccccccgggcagggggtcaccatctcttgttctggaagaagtccaatatcggatcttatcctgtcaactggtatcgggactccaggccaccggccccccgactccttatctatgactactaatcacgcggccctcgacgggggtccctgccccgattctctaggctccaagtctcggcactacngcctaacctgcctatccttgactctcatctgagatgagctgattactatgngcagnagtgggatgacgacggcggagngtggtgtcggcggaggacagtcgacgttgtacgcgacgaccgacgcttccgtcccgtcgtcnctcttccgtcccttccgtc

SEQ ID NO: 367340 - DNA, 531 bp, Homo sapiens
  misc_feature: GZ8MTXP01DHPD7.44.33.C11.1.454.CMB.2.raw
  modified_base (381)..(381): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagactctcctgtgtagcgtctggattcaccttcaacagacatggcatgcacgtggggtcccgccagggcctaccgaggcaagggggctgggagtgggtgctattatatggtatgatggaaaataataatattangtagattccgagaacgggcgatcacatctccagagacaatacgaaagaacaacactatatctaggaaatagaatagcctagagagaccgaggacaacggcttgtcttactactgttgcgagaagagtggggctgttggtaattaacgaag

SEQ ID NO: 367341 - DNA, 765 bp, Homo sapiens
  misc_feature: GZ8MTXP01AL851.44.33.C11.1.454.CMB.2.raw
  modified_base (284)..(284): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagactctcctgtgtagcgtctggattcaccttcaacngacatggcatgcacgtgggtcccgccagggcctccgaggtccaagggggactgggacgtgggggtggctaacgtttatacgtgggtaatggaagttagggaaaaaagttaaattaattatttaagtaggtaaggtaatttcccgggtaggaaacggggtacccgtaatttacccgaaaccctagttaccctacccgaaacggtaaggaaaccctaaagttaaccggaaaaacgaaacctaaacctaaacttaaacttaacgttaaccgtttaaagggaaaaacgttaacggaaaatttacggacccgtttaagggaacggtaaacgggaccccgggaaagggaacccggaaaccgggtcccgtttacggggttaaccctttaaccgttaaccgttaagggttcgggaaccgggaacgggtaaagggtaagggttcgggggggtaccttccggggttagggtaaacgtttaaccggtaaagg

SEQ ID NO: 367342 - DNA, 596 bp, Homo sapiens
  misc_feature: GZ8MTXP01EW1CI.44.33.C11.1.454.CMB.2.raw
  modified_base (280)..(280): a, c, t, g, unknown or other
  modified_base (303)..(303): a, c, t, g, unknown or other
  modified_base (342)..(342): a, c, t, g, unknown or other
  modified_base (459)..(459): a, c, t, g, unknown or other
  modified_base (561)..(561): a, c, t, g, unknown or other
  modified_base (592)..(592): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtccctgagactctctgtgtagcgtctggattcaccttcaacngacatggcatgcacgtgggtccncaggctccgaggcaagggctggagtggggtgacacttanagtggtatggatagggaaattaaataaaaattattaatacggtaagacgtttccggaggaaacgggggtcctaattccaacctataccgtaccaagacgaaactaaattacggaaanaaacctacaacttaatatacggtaaggtaaaataggtaaatagcctaggagaacggccgaaggaccgacgggtctggtacttacgtacgttggtagcggagnggttagtggggactggtggattacgaagttntaag

SEQ ID NO: 367343 - DNA, 599 bp, Homo sapiens
  misc_feature: GZ8MTXP01DRWQX.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggaccccggcagggggtcaccatctctgttctggaagaagtccaatatcggatcttatcctgtcaactggtatcgggactccgagcaccggcccctatcctactctctgctactaatacagaccggccctccgacgggtcccgtcgcccgtacttcctctcggtctaccctacgtaactcgtcgactacgaacgcgtacctcgtcgtactccttcgtatctcctacgtcgtagagtagtgaggactgtattacttacgtgttggcaacgtgaacgtgggtagtaggacgtacggacccgggacgggtaccggtggggtgggttcggggcgggttacgggaacggtaacgttcggttccgttcgtaacggtacgaacgacccgacggcctccgccccgttcccgg

SEQ ID NO: 367344 - DNA, 602 bp, Homo sapiens
  misc_feature: GZ8MTXP01DCXEM.44.33.C11.1.454.CMB.2.raw
  modified_base (302)..(302): a, c, t, g, unknown or other
  modified_base (331)..(331): a, c, t, g, unknown or other
  modified_base (340)..(340): a, c, t, g, unknown or other
  modified_base (376)..(376): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttggctgaccttgggttttcctcgttgcttcttttaagaggtgtccagtgtcaggtgaagctggtggagtcgtgggggagcgtggtccagccgtgggacgtccctgagactctctgtgtagcgtctgattcaccttcaacagacatggcatgcacgtggcccncaggctccgaggcaagggctggagtgggngactattanagtggtatggataggaaataaataaaattattaagngtaagattccggtagaacggggcctatcactatcgtacagagaactaattacgaaacgtaacactaactataactacgtaaggtaaaatagaaatacgaccgtaggagaacgccggaacggacaaccggtcttaacggtaccttaactaccgttggtacggacggttaggacggttagggtcggggtcccttaacgggttacgggaacttacgaaggttaattaag

SEQ ID NO: 367345 - DNA, 565 bp, Homo sapiens
  misc_feature: GZ8MTXP01CK4VD.44.33.C11.1.454.CMB.2.raw
  modified_base (293)..(293): a, c, t, g, unknown or other
  modified_base (351)..(351): a, c, t, g, unknown or other
  modified_base (366)..(366): a, c, t, g, unknown or other
tcagacagtatatacacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgactattggtgttatacttgtctctgtacacaccaccagcaagccccaaatcatcatttangatgtcagtaagcgccctcgaggggtccctgatcgcttcctctgctcaagtctgcacncgcctcctgacctcnctggctccagctgaggatgagctgattattactgacagtctccgagtggacggcaccgttatgtagtttgtcgttttcggggcggtacgggttaccgacggttaccgttacggtaacccggttccgttacgggttaccgaaccggccccggtaaacgggtcccgtaccggttccccccgttcgggttcccttaaccccg

SEQ ID NO: 367346 - DNA, 513 bp, Homo sapiens
  misc_feature: GZ8MTXP01BVR86.44.33.C11.1.454.CMB.2.raw
  modified_base (304)..(304): a, c, t, g, unknown or other
  modified_base (378)..(378): a, c, t, g, unknown or other
  modified_base (384)..(384): a, c, t, g, unknown or other
  modified_base (430)..(430): a, c, t, g, unknown or other
  modified_base (485)..(485): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagctctcctgtgtagcgtctggattcaccttcaacagacatggcatgcactgggtccnccaggctccaggcaagggctgggacgtgggtgcacttatacgtggtatgatggaaaagtaataatattatgtanattcgngaaagggcgattcacatctcagagacaatcgaagaacacactatanctagaatgaatgctagagagccgaggcaacggcttgtcttactactgttgcgagnggagtcggggctggaggaattaacgaag

SEQ ID NO: 367347 - DNA, 549 bp, Homo sapiens
  misc_feature: GZ8MTXP01B0RP0.44.33.C11.1.454.CMB.2.raw
  modified_base (307)..(307): a, c, t, g, unknown or other
  modified_base (484)..(484): a, c, t, g, unknown or other
  modified_base (521)..(521): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagctctcctgtgtagcgtctggattcaccttcaacagacatggcatgcacgtgggtcccnccaggcctccgaggcaaggggactgggagtgggtgctacttatagtgggtatgataggaaaataataatattatgtagtagttccggaggaaacggggcccgtattccaacctatcctaccgaagagactaattcgaaagaacacaactatatctaggaaatgaaatgacctagagngacgaggacaacggcttgtcttactactgttgcgagngagtggggctcggttgaagttaacgaag

SEQ ID NO: 367348 - DNA, 663 bp, Homo sapiens
  misc_feature: GZ8MTXP01BZ9KD.44.33.C11.1.454.CMB.2.raw
  modified_base (285)..(285): a, c, t, g, unknown or other
  modified_base (310)..(310): a, c, t, g, unknown or other
  modified_base (628)..(628): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagccgtgggagtccctgagactctcctgtgtagcgtctggattcaccttcaacngacatggcatgcacgtcgggtcccnccaggcctacccgagggacaaagggggctgggaggtgggggtggccagtttatacgtgggtatggaatagggaaaaaacgttaattaagttattaagtacggtaagtacgttttacccgggagaaacgggggtcccgtaatttacccgaaccctattacccttacccgaaaggaacgtaaacctaaacgtttaaccggaaaacgaaaccaactaaaccttaacgttaatttacggaaggtaaactagtaaagttacgcccggttaagggacgtaccggacggaccgacggaacgtcgttcgtacttacgtcgtgcggngaggaaggtgggcgtcggtgacgtaacttggtaag

SEQ ID NO: 367349 - DNA, 601 bp, Homo sapiens
  misc_feature: GZ8MTXP01DGKK1.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcgagggggtcaccatctcttgttctggaagaagtccaatatcggattcttatcctgtcaactggtatcggggactccgacggcgaccggcccccgactccttatctactgctactaatcacgccggccctcgacggggtccctcgccgacttcctctcggctccaagtctgcactacacggctaccgtcggccactccttgactctccagttcaggagagtgaggtctgtaactttactacgttcgtgacagctaagtgggagtacgaacgagggacccgggaacgggtcggttggggttcggttcggggcgggacgggtaaccgtaaggttcgttacccggttacgtaacggtacgaacggcccgacggttccgtaaccgcccccgttccgg

SEQ ID NO: 367350 - DNA, 542 bp, Homo sapiens
  misc_feature: GZ8MTXP01DRJY1.44.33.C11.1.454.CMB.2.raw
  modified_base (282)..(282): a, c, t, g, unknown or other
  modified_base (310)..(310): a, c, t, g, unknown or other
  modified_base (427)..(427): a, c, t, g, unknown or other
  modified_base (438)..(438): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagcctggggaggtccctgagactctcctgtgtagcgtctggattcaccttnaacagacatggcatgcacgtgggtcccnccagggcctccgaaggcaaggggctgggagtggggtgcattatatggtatgataggaaaataattaatatttatagtaagatttccggtagaacgggtccgattcacatctacaganacaatacgaanaacaacactatatctagaaatgaatagctagagagccgaggacaacggcttgtcttacgtactgttcgcgagaagagtggggtctcggttagaagttaacgaag

SEQ ID NO: 367351 - DNA, 670 bp, Homo sapiens
  misc_feature: GZ8MTXP01D3GCI.44.33.C11.1.454.CMB.2.raw
  modified_base (306)..(306): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggtttcctcgttgctcttttaagaggtgtccagtgtcaggtgaagctggtggagtcgtgggggagcgtggtccagcctgggagtccctgagactctcctgtgtagcgtctggattcaccttcaacagacatggcatgcacgtgggtcccnccaggcctccgaggacgaaggggctgggaggtggggtgctacttatagtggtatgataggaaaaagttaataagtatttaatacgtagtattccggtaggaacgggtccgtattaccaacctataccgttacccaaagtacgaaactaaacgttacgaaaacgaaactaactaacttaattaataccgtaagggtaaaactagaaactacggtaccgtaaggaacggtacggaccccgggaaggaacgtaacccggggtacttacgggttaccttaacgttaaaccggttcggttacgggacggaaagggtaagggtagtaaccggggggtccttacgggggttaggtaacgttaacgtaaagg

SEQ ID NO: 367352 - DNA, 527 bp, Homo sapiens
  misc_feature: GZ8MTXP01AHQ85.44.33.C11.1.454.CMB.2.raw
  modified_base (313)..(313): a, c, t, g, unknown or other
  modified_base (383)..(383): a, c, t, g, unknown or other
  modified_base (420)..(420): a, c, t, g, unknown or other
  modified_base (432)..(432): a, c, t, g, unknown or other
  modified_base (500)..(500): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggacgtccctgagactctcctgtgtagcgtctggattcaccttcaacagacatggcatgccacgtcgggtcccnccaggcctccgaggcaaggggctggaggtgggtgctacttatagtggtatgataggaaaaattaataatnttatgtagattcgagaacggctatcacatctacaganacaatacgaaanaacacactatatcgtagaaatgaatgctagagagccgagcgaacgcttgtccagtacgtgttgcgagngagtcgggctggagtaacgttaagaag

SEQ ID NO: 367353 - DNA, 548 bp, Homo sapiens
  misc_feature: GZ8MTXP01BE9QC.44.33.C11.1.454.CMB.2.raw
  modified_base (206)..(206): a, c, t, g, unknown or other
  modified_base (524)..(524): a, c, t, g, unknown or other
  modified_base (540)..(540): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccggngagggggtcaccatctcttgttctggaagaagtccaatatcggatcttatcctgtcaactggtatcggggactccgaggcaccggccccccgatccttatctatgctactaatcagccgcccctcgacgggtcccgatcggttctccgtggctccagtctaggcaacgacggccctccctgacccgtctcgtcgggctccgaggctgacgagtgaggtctgtattatactgcaggctcgagtggagcacgtatgtattgtcgtttcgggcggtaaggacagacgttcgtaccgtcgttacggttcacgcccgaggccnccgtccccgcggtccncgttcccg

SEQ ID NO: 367354 - DNA, 637 bp, Homo sapiens
  misc_feature: GZ8MTXP01AHRTM.44.33.C11.1.454.CMB.2.raw
  modified_base (263)..(263): a, c, t, g, unknown or other
  modified_base (308)..(308): a, c, t, g, unknown or other
  modified_base (402)..(402): a, c, t, g, unknown or other
  modified_base (593)..(593): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccaggccgtgggagtccctgagactctctgtgtagcgtntggacttccaccttcaacagacagtggcatgcacgtcgggtcccnccagggccctccgaggaccgaaagggggactgggaggttgggggtgactacgttatagtggtatggagtaggaaagtaataaaattatttaagnggttaagagtttcccggtaggaaacggggcctaattaccacctatcctaccgaagacgaacctaagttacgaaacgtaaacaactaactaatatacggtaaggtaaattagaaagtagaccgtaggaacgacgaccggtaaggaccgacgggcctaagtcccttaacgtacgttggtacggacggttaggnggttaggtcggggtacgtcggtaggacgttacgaagaagttaag

SEQ ID NO: 367355 - DNA, 590 bp, Homo sapiens
  misc_feature: GZ8MTXP01EY00E.44.33.C11.1.454.CMB.2.raw
  modified_base (309)..(309): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtggccagtgtcaggtgcagctagtggagtcgtgggggagagcggcccagcctgggaactccctgagactctcctgtgcagcctctggattcattctcaggacctatcgccatgcacgtcggtccnccgaggctccgaggcgaagggggctaggaggtggggtagactaattatatcgaagaagaagttaggaattagaaagaacacgtacggagacgtacgaagaacgggccgatccaccgtctaccgagacacaataccgaagaacacacgtgactactctagactaaagtacgtaaccaacctacaacgtaagtggaacgaacgacgggtcttcggttacttaatttagttgttcgaacgacgaacccgcccccgtagaccggtaacccggttcccgtaaccgg

SEQ ID NO: 367356 - DNA, 542 bp, Homo sapiens
  misc_feature: GZ8MTXP01CDLG8.44.33.C11.1.454.CMB.2.raw
  modified_base (280)..(280): a, c, t, g, unknown or other
  modified_base (385)..(385): a, c, t, g, unknown or other
  modified_base (434)..(434): a, c, t, g, unknown or other
  modified_base (450)..(450): a, c, t, g, unknown or other
  modified_base (468)..(468): a, c, t, g, unknown or other
  modified_base (480)..(480): a, c, t, g, unknown or other
  modified_base (493)..(493): a, c, t, g, unknown or other
  modified_base (519)..(519): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctggggagtccctgagactctcctgtgtagcgtctggattcaccttnaacagacatggcatgcacgtgggtccgccaggcctaccgaggcaagggactggagtgggtgctacttatagtgggtatggaataggaaaagtaattaatatttanagtagaatttccggagaaacgggccgtattcaccatcctacaagacganaagtacgaaagaacanactagtaatctagaaatnaatagctagagngacgagcaacggnttgtcttacgtagtgttgcgagaagngtggggctggttggaattcgaag

SEQ ID NO: 367357 - DNA, 550 bp, Homo sapiens
  misc_feature: GZ8MTXP01B9O4N.44.33.C11.1.454.CMB.2.raw
  modified_base (289)..(289): a, c, t, g, unknown or other
  modified_base (449)..(449): a, c, t, g, unknown or other
  modified_base (502)..(502): a, c, t, g, unknown or other
  modified_base (521)..(521): a, c, t, g, unknown or other
  modified_base (525)..(525): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaatcgtggtggagtcgtgggggagcgtggtccagccgtgggacgtccctgagactctccgtgtgtagcgtctggattcaccttcaacngacatggcatgctacgtggggtcccgccaggcctaccaaggaccgaaggggctgggaggtgggtgctacttatatgggtatgaatgggaaaaataataatattatgtagattccggtagaacgggcctattcacatctacaagtacgactaatacgaaanaacacactatactataggaaatagaagtcgctagagacgacgtagacgaacgnttgtacttacgtagtgagngagngagtgggctggttagaattaagaag

SEQ ID NO: 367358 - DNA, 550 bp, Homo sapiens
  misc_feature: GZ8MTXP01D83GQ.44.33.C11.1.454.CMB.2.raw
  modified_base (273)..(273): a, c, t, g, unknown or other
  modified_base (301)..(301): a, c, t, g, unknown or other
  modified_base (333)..(333): a, c, t, g, unknown or other
  modified_base (438)..(438): a, c, t, g, unknown or other
  modified_base (515)..(515): a, c, t, g, unknown or other
  modified_base (521)..(521): a, c, t, g, unknown or other
  modified_base (542)..(542): a, c, t, g, unknown or other
  modified_base (546)..(546): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtcagcctgggaggtccctgagactctctgtgtagcgtctggattcacttnaacagacatggcatgcacgtgggtcccncaggctccgaggcaaagggctgggaggtgggngactacttagatggtatggataggaaagttaaataaaattattgtacgtaatactttcggaggaaggggtccattacacatcgtcaagagaactaaattcgaaanaacaactaactatatacgtaaggaaatagaactagcctagacgaagccgtaaggacacggctaagtcttactattgngcgagngacgtggggctggtagattanaagntaag

SEQ ID NO: 367359 - DNA, 662 bp, Homo sapiens
  misc_feature: GZ8MTXP01CDXVA.44.33.C11.1.454.CMB.2.raw
  modified_base (309)..(309): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttctttaagaggtgtccagtgtcaggtgaagctggtggagtcgtgggggagcgtggtccagcctggggagtccctgagctctcctgtgtagcgtctggattcaccttcaaacagacatggcatgcacgtgggtcccnccaggcctccgaggccgaaaggggctgggaggtgggtgactacgttatacgtggtatggaagtaggaaaaaagttaataaattatttaataggtaagtacttccggtagggaaacgggtccgtaattaccaacctattacctaccgaagaacgtaactaaacgttacgaaaacgaaacaacctaacttaagtaacttacgttaaaggaaaattagaaaagttacgacccgttaaggacgtaacggaccgaacgggaaccgaaccgggtcttaggtaccttaacgttaacgtggttacggcggaaggaaggtaggtcgggggtccgttacgggttagggtaacttaacggtaag

SEQ ID NO: 367360 - DNA, 561 bp, Homo sapiens
  misc_feature: GZ8MTXP01AP7ZY.44.33.C11.1.454.CMB.2.raw
  modified_base (275)..(275): a, c, t, g, unknown or other
  modified_base (304)..(304): a, c, t, g, unknown or other
  modified_base (374)..(374): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttnaacagacatggcatgcacgtcgggtcccnccaggcctccgaggcgaaagggctgggagtgggtgcattatagtggtatggagtggaaataataaaaatnttaatgtaagtattccggtaggaacggggcctattccaactatctaccaagagaacaagttacgaaagaacaacaactatatacgtaggaaatgaaatagctagaggacgcgagacacggtcaagtcttaataccgttgacggtcgagaggaggtgggggacctgggtaggacttagtaagaataag

SEQ ID NO: 367361 - DNA, 537 bp, Homo sapiens
  misc_feature: GZ8MTXP01DAXOB.44.33.C11.1.454.CMB.2.raw
  modified_base (337)..(337): a, c, t, g, unknown or other
  modified_base (434)..(434): a, c, t, g, unknown or other
  modified_base (499)..(499): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtccctgagactctctgtgtagcgtctggattcaccttcaacagacatggcatgcacgtggtccgcaggcctcgaggcaagggactgggagtgggngcattatagtggtatgataggaaaattaaataagtattataggtaagacttacgtaggaacgggtctattcaccatctaccaagagacaatcgaaanaacacactatactacgtagaatgaatagctagagacgccaggacaacggcttgtacttagtacgngttcgcgagaagagtggggctggaggtaattaacgaag

SEQ ID NO: 367362 - DNA, 574 bp, Homo sapiens
  misc_feature: GZ8MTXP01BABVY.44.33.C11.1.454.CMB.2.raw
  modified_base (276)..(276): a, c, t, g, unknown or other
  modified_base (303)..(303): a, c, t, g, unknown or other
  modified_base (369)..(369): a, c, t, g, unknown or other
  modified_base (530)..(530): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggggagcgtggtccagccgtgggagtccctgagactctcctgtgtagcgtctgattcaccttnaacagacatggcatgcacgtgggcccncaggctccgaggacgaagggctggagtgggtgctattatagtgtatgataggaaataataaaattnttaagtgtagacgttcgaggaacgggcctaatcacatctacagagaactaagttacgaaagaacacaactatactacgtaaggaaatgaaatagccgtaggaacggacgacccggaagaaccgcgggtctggtaccttacgtacgttggacgacggaaggngttaacggtcggggtctcgggtaggattacgaaggttaattaag

SEQ ID NO: 367363 - DNA, 569 bp, Homo sapiens
  misc_feature: GZ8MTXP01DS4YB.44.33.C11.1.454.CMB.2.raw
  modified_base (539)..(539): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctggggagtccctgagactctcctgtgtagcgtctggattcaccttcaaacagacatggcatgcacgtggggtcccgccagggcctccgaggcaagggggctgggagtggggtgctacttatatggtatgatggaaaaattaaataattatttaatagtagtattccggtaggaacgggccgtattcaaccattccaccaagacgactaaatacgaaagaacaacaactatactactaggaaatgaaatagcctagacgagccgaggccgaacggtcttgtacttacgtacgtgttacgcggagnggagtggggctggttggtaacttaacgaag

SEQ ID NO: 367364 - DNA, 710 bp, Homo sapiens
  misc_feature: GZ8MTXP01DJ8UJ.44.33.C11.1.454.CMB.2.raw
  modified_base (320)..(320): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggaggcgtggtccagccgtgggacgtccctgagactctctgtgtagcgtctggattccaccttcaacagacagtggctatcggctacggtcggggtcccnccgagggccctaccgaagggacgaaagggggtaccttgggggaggttgggggtgactacgttatagtggtatggtaagtaagggtaaaaaattaaattaagttatttaagtagggttaaagtagtttacccgggagggaaacggggtccgttaattccaaccctattccgtaacccgaaaggtaacaactaaacgttacggaaaacaaacctaaactaaccttaagttaacgttacgttaaaggtaaaagttaagtaaacgttacgaccgtaaggaacggacggacccggaaggaccgaacggtcgttacggttaccttaacgttaccgtggttacgggcggaaaggaacgtagggtcggggtcttacgggttagggtaacttaagtaag

SEQ ID NO: 367365 - DNA, 692 bp, Homo sapiens
  misc_feature: GZ8MTXP01ARYJD.44.33.C11.1.454.CMB.2.raw
  modified_base (308)..(308): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggtttcctcgttgcttctttaagaggtgtccagtgtcaggtgaagctggtggagtcgtgggggagcgtggtccagcctgggacgtccctgagctctctgtgtagcgtctggattcaccttcaacagacagtggcatcgcacgtgggtcccnccgaggcctaccgaggcgaaggggctggggagtgggtgcctagttatacgtggtatggaagtaggaaaaaagttaaattaattagtttaaagtaggttaagtacgtttaccgggtaggaaacggggtaccctattaccaacctacttcctacccgaaaggtacgtaaacctaaacgttaaccggaaaacgtaaacctaaaccgtaaccttaattaaacgttacggtaaaggaaaacgttaagaaacgtacgtaacccgtaggaacggaacggaacccgggaagggtaaccgtaacggggtccttacggtaacccttaacgtaaccgttggacggacggttaaggaaggtaggtcgggggtactcgggttagaacgttaacgaag

SEQ ID NO: 367366 - DNA, 698 bp, Homo sapiens
  misc_feature: GZ8MTXP01BQQYT.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttcgctctcctcctcaccctcctcactcactgtgcagggtcctgggcccagtctgtgatgtctcagcccaccctcagcgtcgtcgggacccccgggcgagggggtcaccatctcttgttctggaaggaagtccaatatcggatcttatctgtcaactggtacgtcggggacctccgaggccacccggccccccgacttcccttatctatgactaactatcacgccgccctcgacgggtccctgcccgtacttcctcgtcggcctaccgaaagttccgtggcctaaccgtacgacggtcctaccgtcgggaccctacttcccttaggacttcctaccctagttccgtaggaggtactggaacggtcttagtaactttacgtacgttggtgactagcgtagtggggtatacgaccgacggtaccggggaacgggtcgttacgggggttcgggtttaccggggcggggtaaaccggggtaacccgttaaagggttcccggttaaaccccgggtttccgttaaacggggttccgaaacccgggaccccggttaaaacggggtcccgttccccgggttaaccccccccgg

SEQ ID NO: 367367 - DNA, 665 bp, Homo sapiens
  misc_feature: GZ8MTXP01AD20Q.44.33.C11.1.454.CMB.2.raw
  modified_base (316)..(316): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggggagcgtggtccagcctgggagtccctgagactctcctgtgtagcgtctggattcaccttacaaactagacagtggcagtgcacgtcggggtccccnccagggcctccgaggccgaagggggactggggagtggggtggctacgttatagtgggtatggaagtagggtaaaaagttaaattaattatttaagtagggtaacgtacgtttaccgggtagggtaaacggggtcccgtaatttaccaaccgtacttcccgtaccgaaggtaacgaacgtaaattaccggaaaacgaacctaaataacccttaattactacgtaagggtaaaattaggaaatacgtaccgtaggaacggacggacccggaaagggaccgtaacggtcttaggtaccttaacgtacgtggttcgcgttaggaagagtgggctggttaggtaacttaagaag

SEQ ID NO: 367368 - DNA, 765 bp, Homo sapiens
  misc_feature: GZ8MTXP01AQ2BB.44.33.C11.1.454.CMB.2.raw
  modified_base (247)..(247): a, c, t, g, unknown or other
  modified_base (268)..(268): a, c, t, g, unknown or other
  modified_base (313)..(313): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagcctgggagtcccngagactctcctgtgtagcgtntggattcaccttcaacagacatggctatggcacgtcggggtcccnccgaggcctccgaggcgaaggggctgggaggtgggtgctacgttatagtggtatgagtggtaaaaattaaattaagtatttaagtacgggtaagtacgtttaccggtagggtaaacggggtcccgtaatttacccaacccgtattacccgttacccgaaagggtaaccgtaaactaaaacgtttaaccggaaaacgtaaacctaacctaaaccttaaaggtttaaacttacggttaaacgggtaaaactaacggtaaattaacggtaccccgttaaagggaacggtaaaccgggaaccccgggtaaggggtaacccggaaccgggtccgttacgggttaaacccttaaccgttaaacccgttgggttacccgggaacgggacggggtaaacgggtaggggttccggggggtaccgttcggggttaacggggtaagtttaacccggtaaaggg

SEQ ID NO: 367369 - DNA, 589 bp, Homo sapiens
  misc_feature: GZ8MTXP01B9W0S.44.33.C11.1.454.CMB.2.raw
  modified_base (291)..(291): a, c, t, g, unknown or other
  modified_base (408)..(408): a, c, t, g, unknown or other
tcagacagtatatacacgaccggtgctcgatttagagtgagctcgttgggtttgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaagagtccaatatcggatcttatcctgtcaactggtatcgggactcccgaggcaccggccccccgactccttanctatgctactaatcagccggccctcgacggggtcccctgccccgtatttctctcggcctccaagtctcggccactacgaggcctaaccctggcccatccttgactctcagtctgagntgaggctgtattactacttgtgctagcagtggggggatggacgtaggacccgggaaggcgttggggtcggtcgggcgggacgggtacctaaggttcgaccgttcgtaggttccacggcccgaggttccttaccgcccccgttcggtcctaccgttccgttccggttccccgcccgtttccc

SEQ ID NO: 367370 - DNA, 668 bp, Homo sapiens
  misc_feature: GZ8MTXP01C2UMP.44.33.C11.1.454.CMB.2.raw
  modified_base (445)..(445): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcgggacccccgggcgagggggtcaccatctctttgttctggaaggaagtccaatatcggattcttatcctgtcaacgtggtatcgggactcccgaggccaccggccccccgatccttatctatcgacctataatcgagccgcccgtggaccggggtcccctggccccgtatttccgtcgtcggtcctaccgaagttccgtcggacctaaccgtacgacggtcctaaacccgtggccctattccgttagactcctctagtctgagtntggaggtctagtattactctgtcgcagcgtagtgggggaactcggaacgacgggaccgggtaacggtcggttggggttcgggtcgggacgggtacgggaccgtaagggtttccggacccggttcgtacggttccgacggccccgttaacgggttcccttcccggaacccccggttcggtccctaccggttcccttacccgttcccccgttaaccccgttttcc

SEQ ID NO: 367371 - DNA, 557 bp, Homo sapiens
  misc_feature: GZ8MTXP01CBGV5.44.33.C11.1.454.CMB.2.raw
  modified_base (307)..(307): a, c, t, g, unknown or other
  modified_base (437)..(437): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacccgggttttcctcgttgctcttttaagaggtgtccagtgtcaggtgaagctggtggagtcgtgggggagcgtggtccagccgtgggagtccctgagactctcctgtgtagcgtctggtattcaccttcaacagacagtggcatgcacgtcgggtcccncaggcctccgaggcaagggctgggagtggggtgctacttagtagtggtatgagtaggaaagtaaataaataattatgtagtattccgagaacgggcctattccactatcctacagacactaattcgaaanaacacactaatatctaaggggaaatgaaatacgacctgagacgaccgagaccacggtctgtcctaacttcgtgttgacgagacgagttggggctaggtgtatacgagtaacgttaagtcg

SEQ ID NO: 367372 - DNA, 642 bp, Homo sapiens
  misc_feature: GZ8MTXP01E05JQ.44.33.C11.1.454.CMB.2.raw
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcgggaccccccgggcgagggggtcaccatctcttgttctggaagaagtccaatatcgatcttatcctgtcaactggtatcggggactccgaggccaccggcccccgactccttatctatgctactaatcacgcgccctcgacgggtccctgccgtattctcgtgctcagtctcggcactacgagcctaaccgtcgcctatccttagactcctcagtctgagtatgagctgtacttactactgtgcagcgtagtggggggatacggacgacgggacccgggaacgggtcggttggggttcgggttccggggacggggtaacgggggtaaccctaaggggttcccggtaacccggttaccggtaacgggttccgaaccgggtaccccgaacggggttccttaccccggtccccccgtagggttcccaccgttccgttcccgtttcccccgttaacccctttcccg

SEQ ID NO: 367373 - DNA, 597 bp, Homo sapiens
  misc_feature: GZ8MTXP01A4U3S.44.33.C11.1.454.CMB.2.raw
  modified_base (440)..(440): a, c, t, g, unknown or other
tcagacagtatatacacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatcctcctgcactggcaccagcagtgactagttggtgttatactttgtctctgtaccaacaccaccagcaaacgccccaaatcatcatttatgatgtacagtaacgccggtccctcgacggggtccctgactcgtcttcctctggctccagtctggcaacgaccggccctcccgtgtacccgtctcgtcggcctcgagctgagatgagtctgactattctcgcgttccctanattacgtcgaccgaggtccgtaacgttaggttttactacgttccgttacgggaaacgttgggaacccgtaaaggttcccgtaaccggttcccttaaccgttccaacggaaccccgaacggaaccccaacccctcgttcgcccgttaaccgttccccg

SEQ ID NO: 367374 - DNA, 699 bp, Homo sapiens
  misc_feature: GZ8MTXP01AOS0T.44.33.C11.1.454.CMB.2.raw
  modified_base (183)..(183): a, c, t, g, unknown or other
  modified_base (319)..(319): a, c, t, g, unknown or other
  modified_base (371)..(371): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagnggtgtccagtgtcaggtgaagcgtggtggagtcgtgggggagcgtggtccagcctggggacgtccctgagactctcctgtgtagcgtctggacttccaccttacaacagacagtggcatgctacgtggggtccccncgaggcctccgaggcgaagggactgggaggtggtcgctattagacgtggtangataggaaaattaataatagttagtgtagacgtttccggaggtaacgggctagttaccactataccgtaccgaagacgtaacgtaagttacggaaactaacaactaacttaagtaacgttacgtaagggtaaacttaggtaaacgttacggacccgttaagggaacggtaaccgggtacccgggtaaacgggaaccggtaaccgggtccgtttaccggttaaccttaaccggttaaccggttcgggttacgggttaccgggttaaacgggtaagggtaacggttcggggggtacccttacggggttagggtaaccttaacgggtaagg

SEQ ID NO: 367375 - DNA, 607 bp, Homo sapiens
  misc_feature: GZ8MTXP01EYJUI.44.33.C11.1.454.CMB.2.raw
  modified_base (435)..(435): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggaccccccgggcgacgggggtcaccgatctcttgttctaggaagaagtccaatatcggatcttatcctgtcaactggtatcggggactcccgaggcaccggccccccgactccttatctatgctactaatcagccgccctcgacggggtccctcgcccgtattcccctcgtcggctccaagtcctacggcaaccttacgacgggcctacccgtgggccctacttcccttgacttcncccagtcttagaggtatgagctgtaattactacgtgttcggcagcgaagtgggaatggactacggaccgggaacggtcgtgggggttgttccggggaggaccgggtacgtaaggttcgaccgttccgttaaggccgaaccgccgaacgggttcctccggttccccgttccgg

SEQ ID NO: 367376 - DNA, 580 bp, Homo sapiens
  misc_feature: GZ8MTXP01DIUAI.44.33.C11.1.454.CMB.2.raw
  modified_base (338)..(338): a, c, t, g, unknown or other
  modified_base (347)..(347): a, c, t, g, unknown or other
  modified_base (503)..(503): a, c, t, g, unknown or other
  modified_base (518)..(518): a, c, t, g, unknown or other
tcagacagtatatacacgaccggtgctcgatttagagtgagctcgttgggtttggggctggggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtggggggagcgtggtccagccgtgggacgtccctgagactctctgtgtagcgtctggattcaccttcaacagacatggcatgcacgtgggtccgccaggcctccgaggcaaggggctgggagtgggngacacttangtggtatgatggtaaataataaaattatttaagtagtaagtattccgaggaacggggcgtattcacatctaccagtagaactaattacgaaagaacaactaactaattaactacggtaaggaaatagaaatacgcctagaggagcgaagacgacgntgtcttaacttacgngttacgcggaaggttgagggtcggggtacttcgggtagggaattaccggaagttaagttaag

SEQ ID NO: 367377 - DNA, 626 bp, Homo sapiens
  misc_feature: GZ8MTXP01EZDSK.44.33.C11.1.454.CMB.2.raw
  modified_base (379)..(379): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggacccccgggcgagggggtcaccatctcttgttctggaagagtccaatatcggatcttatcctgtcaactggatcgggactcccaggccaccggtcccccgactccttatctatgctactaatcagccgccctcgacggggtccctgcccgattccctctggctccaagtctgcactacngctacctcggcctactccttgactctcagtctagaggtatgaggctagtattaactacgtgtgcagcaagtgggatacggacacgggtacccgggaaacggtccggttaaggggtcgggtttcgggggaccgggaacggggtaaacccgtaaggttaccggttaaccccggttaccgtaaggggttaccctaacccggggtacccctaaacggggccgttaaccccggttcccccccggtttccggg

SEQ ID NO: 367378 - DNA, 730 bp, Homo sapiens
  misc_feature: GZ8MTXP01EPGXH.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggaggcgtggtccagccgtgggagtccctgagactctctgtgtagcgtctggattcaccttcaacagacatggcagtcgcacgtcgggtcccgcctaggcctccgaggccgaaagggggaccttaggggacggttgggggttagccgtaacgtttaagtacgttggggtaaatggtaaagtaggggtaaaaaagttaaaattaaagttagtttaagttaggtaaggtacgtttacccggagggtaaacggggacccttaagtttcccaacgtaacttaccgttacccgaaggtaacgtaaaccctaaagtttaacgaaaacgaaaccaaccgtaacttaaacgtaattaccgttaagggaaaatagaaacgtaacgcgtacggaacgtaaggacccggaaacgggtaaccgaacggtcgttacggtacctttaaacctacggttgttcggccgttaaggaacggtaggtaacgggggtctacccggggttaggtaacgttaacgtaaagg

SEQ ID NO: 367379 - DNA, 706 bp, Homo sapiens
  misc_feature: GZ8MTXP01B0LKX.44.33.C11.1.454.CMB.2.raw
  modified_base (286)..(286): a, c, t, g, unknown or other
  modified_base (314)..(314): a, c, t, g, unknown or other
  modified_base (351)..(351): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcgtgggggagcgtggtccagccgtggggacgtccctgacgactctcctgtgtagcgtctggattcaccttnaacagacatggcatgcacgtgggtcccnccaggcctaccgaggaccaaagggctgggaggtgggngactattatagtggtatggataggaaaaagttaaataattattatacgtagtacgtttccggtaggaaacgggtcctattccaaccgtataccttacccgaaaggtaacgtaaactaaacgttaccggaaaacgaaacctaacctaaactttaaagttaacgttaacgtaaacggggtaaaaaatttacgggaaacttaacggcccgttaaagggaacggtaaccggacccgggaaacgggaccgtaacccggggtccttggttaacccgttaactttaccggtggttacggcggttaaggaaaggtggggttcgggggttacccgtagggttaggggtaaacttaacgtaaggg

SEQ ID NO: 367380 - DNA, 581 bp, Homo sapiens
  misc_feature: GZ8MTXP01D0KYP.44.33.C11.1.454.CMB.2.raw
  modified_base (273)..(273): a, c, t, g, unknown or other
  modified_base (277)..(277): a, c, t, g, unknown or other
  modified_base (299)..(299): a, c, t, g, unknown or other
  modified_base (328)..(328): a, c, t, g, unknown or other
  modified_base (336)..(336): a, c, t, g, unknown or other
  modified_base (344)..(344): a, c, t, g, unknown or other
  modified_base (368)..(368): a, c, t, g, unknown or other
  modified_base (535)..(535): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggacgtcctgagctctctgtgtagcgtctggattcaccttnaacngacatggcatgcacgtgggccncaggctcgaggacaagggctggagtgggngctattanatggtaanggaagtggaaataataaaaagttnttaagtgtaacgtatttccggaggaaacggggtcctaattcactatctaccaagaagaaactaattaccgaaagaaacactaataatactacgtaaggaaatagaaatagcctagacgacgccgaaggacacggtctaagtcttacgtacttggtagcgttaagggngttaggtcgggggtctcgggttaggaacttaggaagttaagttaag

SEQ ID NO: 367381 - DNA, 683 bp, Homo sapiens
  misc_feature: GZ8MTXP01B3MWO.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcacgccaccctcagcgtccgtcggggaccccgggcgagggggtccaccatctcttgttcgtaggaaaggaacgtccaatagtcggtattcttatcctgtacaacgtggtagtccgggacctcccgacggccgacccggccccccgacttccttactctactcgacctaactaatcgacggtcccggcccgtcgacggggttcccctcgcccgtacttcccgtccgtggcctaccaagttccgcggccactacgacggtaccttaccgtcgggaccctacgttcccttacgtacttccgtccgtaacggttcgtagggtaggtagtacggacggtcgtagtaacgtttaccgtacggttggtcgacagcgtaaggtggtacgtacggacgtacgggaccggtaaccgggtggtcggggttgggttcggggacggttacgggaccgttaaggttccggttaccggttccggtggcgtaacgacccgtacggccgtcccgcccgttcccg

SEQ ID NO: 367382 - DNA, 570 bp, Homo sapiens
  misc_feature: GZ8MTXP01EAX3N.44.33.C11.1.454.CMB.2.raw
  modified_base (179)..(179): a, c, t, g, unknown or other
  modified_base (281)..(281): a, c, t, g, unknown or other
  modified_base (303)..(303): a, c, t, g, unknown or other
  modified_base (309)..(309): a, c, t, g, unknown or other
  modified_base (330)..(330): a, c, t, g, unknown or other
  modified_base (338)..(338): a, c, t, g, unknown or other
  modified_base (344)..(344): a, c, t, g, unknown or other
  modified_base (493)..(493): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgaccttgggttttcctcgttgcttcttttaagnggtgtccagtgtcaggtgaagctggtggagtcgtgggggagcgtggtccagcctgggacgtcctgagctctctgtgtagcgtctggacttcaccttcaaacngacagtgcatgcacgtggcccncagccncgaggcgaaggctggagtggngctattangtgtangataggaaattaataaaatattaagtgtactagttcgaggacgggctattccactactctacagaacgaataacgttacgaaagaaccaactaattaatactacgtaaggtaaatagaaactacgcctaggacgaacggcgaacggacncggtctaagtccttacgtacgttgtggaacggaggagttagggtcggggtactcgggtagaagttataaggaataag

SEQ ID NO: 367383 - DNA, 652 bp, Homo sapiens
  misc_feature: GZ8MTXP01B2CVP.44.33.C11.1.454.CMB.2.raw
  modified_base (607)..(607): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttggctgaccttgggttttcctcgttgcttcttttaagaggtgtccagtgtcaggtgaagcgtggtggagtcgtgggggagcgtggtccagccgtgggacgtccctgacgactctctgtgtagcgtctggacttcaccttcaacagacagtggcatcgcctacgtcgggtcccgccgaggcctaccgaggcgaaggggacgtgggaggtgggtcgactaacgtttagtacgtgggtatgtaagtaggtaaaaaagttaaattaaagttatttaagtagttagtacgtttccgggtagggaaacgggtcctaagttcccaacctacttaccctacccgaaagaacgtaacctaaacgttacgaaaacgaaacaactaacttatactacgtaaggaaattagaaatcgccgtagacgacgaccgaaggaccgaaggtcttggtaccttacgttaacgtggttacgnggaggtaacggtggtcggggtcctagggttagtaacgttaagaag

SEQ ID NO: 367384 - DNA, 623 bp, Homo sapiens
  misc_feature: GZ8MTXP01A6XDN.44.33.C11.1.454.CMB.2.raw
  modified_base (317)..(317): a, c, t, g, unknown or other
  modified_base (352)..(352): a, c, t, g, unknown or other
  modified_base (432)..(432): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtggggacgtccctgacgtctctccgtgtgtacgcgtctggtattcaccttacaacagacagtggcatgcacgtgggcccnccgagcctaccgaggcgaagggactgggagtgggngctagttatagtggtatgataggtaaaattaaataagtattagtagtagtattccggagaagggtcctattccaaccgtnttaccgaccaagaacgtaactaaattacgaaaagaaaccaactaacttaataactcgtaaaggtaaatagaactacgtaccgtagacggaacgaccgggaaggaccgaacgggtcttacgtacttaccgtagtggttacgcggaaggaaggtaggtcgggggtccgttacgggttaggtaacgaaggtaag

SEQ ID NO: 367385 - DNA, 647 bp, Homo sapiens
  misc_feature: GZ8MTXP01EYYY1.44.33.C11.1.454.CMB.2.raw
  modified_base (253)..(253): a, c, t, g, unknown or other
  modified_base (551)..(551): a, c, t, g, unknown or other
  modified_base (581)..(581): a, c, t, g, unknown or other
  modified_base (611)..(611): a, c, t, g, unknown or other
  modified_base (620)..(620): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcgtgggggagcgtggtccagccgtggggacggtccccngacgtctcctcgtgtgtagtcgtgtagtacttcctaccttacaacgagactaggtcggactagtcgaccgtacggtccgggtccccgacgacggcctaccggaggacggaagggtcggtagggtagggtgggtgacttagttataggtaggtagtagaggtaagtaaaagttaaattaatttattagtagtagttacgtacgggtagggacggaccttataccgactattccgacgaagtaacgtaataacgtaacgaaactaaacactattaatacgtagtaaaggtaatagtaacncgtacgagaacggtacgacggaacgaccgnggtcttagtaccttaatcggtgttacgganaggtaacgnggttggccgtgaggtaacttaagtaag

SEQ ID NO: 367386 - DNA, 694 bp, Homo sapiens
  misc_feature: GZ8MTXP01BWDH4.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttggctgaccttgggttttcctcgttgcttcttttaagaggtgtccagtgtcaggtgaagctggtggagtcgtgggggagcgtggtccagccgtgggacgtccctgacgctctctgtgtagcgtctggattcaccttcaacagacatggcatcgctacgtcggggtcccgccgagggcctacccgaggtaccgaaagggggtccttaggggaggttggggttacggacctaacgttttaagtaacgttgggttaatggaattacggggtaaaaaattaaaattaattatttaaagtaggtaacgtagttttacccggagggaaacggggtcccgtaattaccgaaccctattacctacccgaaaggtaacgtaaacgtaacgttaacggaaaacaaaccaacgtaaacttaagttaacttacgttaagggaaaacttggaaaacttacggacccttaggaacgtacgaccggaaggaccaacgggtccttagtaccttacgtacgtggttcgcggaagtggaggtcgggactcggaggtaacttaagtaag

SEQ ID NO: 367387 - DNA, 749 bp, Homo sapiens
  misc_feature: GZ8MTXP01A3D9D.44.33.C11.1.454.CMB.2.raw
  modified_base (194)..(194): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcgggaccccccgggngagggggtcaccatctcttgttctggaagaagtccaatatcggatcttatcctgtcaactggtatcgggactcccgaggccaccggccccccgatccttatctatgctactaatcagccgcctcgacggggtccctcggccccgtatttcctcgtcggcctaccgtaagtcgtcggcctacgtacgacggtccctaaacccgtcgggccctaattcccgttagacttcctacccgtagttccgtggaaggtatggaggtccttaggtaactttaactacgtggtacgccgtagccgtaaggttggggggactacgggaaccgacggggacccggggtaacggggtccggttgggggttaccgggttaccgggggacgggtaaccggggtaaccccgtaaagggttcccggtaaaccccggttacccggtaggggttaccgaaaccgggaccccgaaacggggttccccgttacccgggcccccccggtttacgggtaacccttaaccccgtttcccgttaccccggtttaacccccccgccccgttttaaccccg

SEQ ID NO: 367388 - DNA, 733 bp, Homo sapiens
  misc_feature: GZ8MTXP01E3X76.44.33.C11.1.454.CMB.2.raw
  modified_base (207)..(207): a, c, t, g, unknown or other
  modified_base (452)..(452): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccacctcagcgtcgtcggggaccccggngagggggtccaccatctcttgttcaggaaagacgtacaatatcggattcttactctgtacaacgtggtacgtcggggacctcccgaggaccgaccccggaccccccgtacttacccgttatctatcgacttactaatcgacggccggtccctcggacggggttccctcgcccgtacttccctacgtcgtactaccgtaagtcctcggcctaacgtacacggtcctcgtacggctacttccgttanactctaccgtagtcgtaggaacgtgtacggtacggtcttaacggttaattaacccgtttacggtggttaccgaactaccggaagttaacggttacggggtaactttaaccggacggggtaccccgggtaacgggttacggttcggggttaacggggttacccggggaacgggggtaacggttaaccggtaaacgggttccggacccgggtttacgttacggggaacccgaaccggtccccggttaacggccccgttccccggtccccgttccggttaaccc

SEQ ID NO: 367389 - DNA, 542 bp, Homo sapiens
  misc_feature: GZ8MTXP01BAOA2.44.33.C11.1.454.CMB.2.raw
  modified_base (268)..(268): a, c, t, g, unknown or other
  modified_base (310)..(310): a, c, t, g, unknown or other
  modified_base (383)..(383): a, c, t, g, unknown or other
  modified_base (401)..(401): a, c, t, g, unknown or other
  modified_base (418)..(418): a, c, t, g, unknown or other
  modified_base (438)..(438): a, c, t, g, unknown or other
  modified_base (443)..(443): a, c, t, g, unknown or other
  modified_base (481)..(481): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagccgtgggagtccctgagactctcctgtgtagcgtntggattcaccttcaacagacatggcatgcacgtggggtcccnccagggcctccgaggcaaggggctgggacggtggggtgcacttatatggtatggatggaaaagttaataattnttaatggtatattccggngaaacgggccattcacntctacagagacaatcgaaanaacanactatatacaggaaactgaatgctagagagccgagacncggcttgtcttacgtacgtgttcgcgagaagaggtcgggctcgggttaggaattaacgaag

SEQ ID NO: 367390 - DNA, 629 bp, Homo sapiens
  misc_feature: GZ8MTXP01CIOFS.44.33.C11.1.454.CMB.2.raw
  modified_base (294)..(294): a, c, t, g, unknown or other
  modified_base (320)..(320): a, c, t, g, unknown or other
  modified_base (570)..(570): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtggggacgtccctgagctctccgtgtgtagcgtcgtggtacttccaccttacaaacngacagtggcatgcacgtcgggtcccncaggctaccgaggcgaaggggtctgggacggtgggtcgactacgtttagtacgttgggtataggaagtaggtaaaaaagttaaattaatatttaagtcgtagtacgttccggtaggacgggtacctattaccactactcctacgaagaacgtaactaaacgttacgaaacaaacactaacttaataacgttacgtaaaggaaatagaacgtacgccgtaaggacgtacggaccgaacggacgaaccggtnttacggtaccttacgtacgttgaggcgagtaaggagtcggggctggagtaagaagtaag

SEQ ID NO: 367391 - DNA, 605 bp, Homo sapiens
  misc_feature: GZ8MTXP01BGSFR.44.33.C11.1.454.CMB.2.raw
  modified_base (288)..(288): a, c, t, g, unknown or other
  modified_base (309)..(309): a, c, t, g, unknown or other
  modified_base (349)..(349): a, c, t, g, unknown or other
  modified_base (451)..(451): a, c, t, g, unknown or other
tcagacagtatatacacgaccggtgctcgatttagagtgagctcgttgggtttgggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtggggagtccctgagctctcctgtgtagcgtctggattcaccttcaaacngacagtgcatgcagtgggccnccaggcctcgaggcaagggctgggagtgggtgctagttanagtggtatgataggaaaaattaataatattaagtgtagtacttcggtagaacgggcctaattccaacgtatccacgaaggactaactaattaccggaaaaanaacaactaacttaagtaactacgtaaagtaaatacgtaaagtacgtacgtaaggaacgtacggaccgacggaaccgaacgtcttagtaccttacgtacgtgttacggacggttaagaaggtaggtcgggtctaggttacgtaacgttaacgaag

SEQ ID NO: 367392 - DNA, 745 bp, Homo sapiens
  misc_feature: GZ8MTXP01ADCDV.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcggtgggggagcgtcggtccagccgtgggacgtccctgacgctctccgtgtgtagcgttcgtggtacttccaccttacaaactacggactagtcggacatcggacctaccggtcggggtccccacgagggcctccgaagggacgaaggggtcgttggggaagggttggggtacgtacctaaacgtttaagtacgttagggtaatacggaaagtaaggggtaaaaaacttaaaatttaaagttacgtttaaagtggttaacgtacgtttcgggtaagggaaaccgggtaccgtatttacccaaccgtacttacctacccgtaaaggacgtaaacctaaagttaacgaaacgtaacctaactaactaagtaactacgtaagaaacttaagacgttacgccgtaggaacggaccgaccggtaacggaccgtaacggtcgttacggttaccttaacgttaccggtgttaccggcgggttaaacgggtaaggtgggtcgggggtaactccggggttaggtaaccttaacgtaaag

SEQ ID NO: 367393 - DNA, 562 bp, Homo sapiens
  misc_feature: GZ8MTXP01DKPH9.44.33.C11.1.454.CMB.2.raw
  modified_base (277)..(277): a, c, t, g, unknown or other
  modified_base (282)..(282): a, c, t, g, unknown or other
  modified_base (306)..(306): a, c, t, g, unknown or other
  modified_base (343)..(343): a, c, t, g, unknown or other
  modified_base (355)..(355): a, c, t, g, unknown or other
  modified_base (362)..(362): a, c, t, g, unknown or other
  modified_base (389)..(389): a, c, t, g, unknown or other
  modified_base (436)..(436): a, c, t, g, unknown or other
  modified_base (501)..(501): a, c, t, g, unknown or other
  modified_base (503)..(503): a, c, t, g, unknown or other
  modified_base (526)..(526): a, c, t, g, unknown or other
  modified_base (541)..(541): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctgggtggagtcgtgggggagcgtggtccagccgtgggagtccctgagactctcctgtgtagcgtctggattcaccttnaaacngacatggcatgcacgtgggtcccnccaggcctccgaggcaaaggggtctggggtagtgggngacttacgttangtggtanggtaagtaggaaattaataaaaaattnttaagtgtaacgtatttccggaggaacgggctatccacatctcaganaactaacttacgaaagaacacaataatatagtaagaatagaatacgctagagacgcgagacgcgntntcttactacgttgtgacgttagngaggtcggggctggnggtattagtaagttaagtaag

SEQ ID NO: 367394 - DNA, 651 bp, Homo sapiens
  misc_feature: GZ8MTXP01DKRB0.44.33.C11.1.454.CMB.2.raw
  modified_base (283)..(283): a, c, t, g, unknown or other
  modified_base (519)..(519): a, c, t, g, unknown or other
  modified_base (613)..(613): a, c, t, g, unknown or other
  modified_base (617)..(617): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggaggtcgtgggggagcggtggtccagccgtgggagtcctgagactctctgtgtagcgtctggattcaccttnaacagacatggcatgcacgtcgggtccgccaggcctccgagggaccgaagggggtaccgtggggaggttgggggtcgactaacgtttagtagttgggtatggtaagttaaggggtaaaaaaatttaaaattaaagttatttaacgtagggttaaacgtacgtttaccgggtagggaaacggggtccctattaccacctaatcctaccgaaaggaactaactaaacgttacgaaaanaacctaactaacttaattaactacgtaaagtaaatagaaatagccgtaagagtacggacgacggacgaacgtcgttgtacttacgtacgtgagngagnggaggtaacgggctcggttaggaacttaacgaag

SEQ ID NO: 367395 - DNA, 575 bp, Homo sapiens
  misc_feature: GZ8MTXP01AXQVV.44.33.C11.1.454.CMB.2.raw
  modified_base (232)..(232): a, c, t, g, unknown or other
  modified_base (295)..(295): a, c, t, g, unknown or other
  modified_base (367)..(367): a, c, t, g, unknown or other
  modified_base (425)..(425): a, c, t, g, unknown or other
tcagacagtatatacacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcttggacagtcagtcaccatctcctgcactgcaccagcagtnactgttggtgttatacttgtctctgtaccacaccaccagcaaacgccccaaatcatcatttangatgtcagtaagccggccctcgacgggtccctgactcgcttccgctggctcagtctggcaacgcgcctcccngacctctcgtgggctccgaggtctggaggactgagtctgtacttattcgcgtctcctnatacgtgccgaggccgtaagttggttttagtcgttacgttacgggtaacgtcggggttaacctaacggttccgaacccggttccttacggttcccgaacgaaccccgtaacggaaccccaaccccgtcttacgttccgaacctttccccg

SEQ ID NO: 367396 - DNA, 603 bp, Homo sapiens
  misc_feature: GZ8MTXP01BV470.44.33.C11.1.454.CMB.2.raw
  modified_base (180)..(180): a, c, t, g, unknown or other
  modified_base (376)..(376): a, c, t, g, unknown or other
  modified_base (454)..(454): a, c, t, g, unknown or other
  modified_base (477)..(477): a, c, t, g, unknown or other
  modified_base (595)..(595): a, c, t, g, unknown or other
tcagacagtatatacacgaccggtgctcgatttagagtgagctcgttggggtttggggggggtctcaggaggcagcgctctcaggacgtcaccaccatggcctgggctctgctcctcctcaccctcctcactcgagggcacgagggtcctgggcccagtctgccctgactcagcctcccncgcgtccgggtctctggacagtcagtcacatctcctgcactggccaccagcagtgactagttggtagttattaacttgtctctggtaccaacaccaccaggacaaacgccccaaatcatctatttatcgatgtcaagtaacgccggccctacggacggggtccctagactcgtcttccgtcgtgcctacaagttcncgggccaaacgccggtcccctccctcgtacccgtcttccgtggcctcgaggcgtgaggtataggaggctcgtaacttnttcgtcgtctctactaatctgcnggcgtaagtttgtttaacgtcgtttaccggagtaacgtcgggaaccgtaaacgttccgtaaccggtcttaccggttcaccggtaacccgacgaaccctaaaccccgtcttcgtaaccncgtttccc

SEQ ID NO: 367397 - DNA, 709 bp, Homo sapiens
  misc_feature: GZ8MTXP01EJQAP.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtggggagcgtggtccagcctgggagtccctgagactctcctgtgtagcgtctggattcaccttcaacagacatggcatgcacgtcgggtcccgcaggcctaccgaggacgaaggggaccgtggggacggtgggggttacgctactttagtaacgtggtatggaattagggaaaaaagttaaaattaagttaagttttaataggttaaagtacgttttaccggggtagggtaaacggggtccgtaagtttacccaacctaacttcccgttacccaaacggaacgtaaaccgtaaacgtttaccggaaaaacgaaacctaaactaaactttaaacttaacgttacgttaaaggtaaaataaggtaaactaacgttaccgtaaggtaacggaacgaccggaacgggaccgaacggtaccgttacgttcgttaaccgtacgttcggacggttcgaggaacggtaggtcggggtctcgggttaggtaagttaacgaagg

SEQ ID NO: 367398 - DNA, 528 bp, Homo sapiens
  misc_feature: GZ8MTXP01BQQ4V.44.33.C11.1.454.CMB.2.raw
  modified_base (285)..(285): a, c, t, g, unknown or other
  modified_base (309)..(309): a, c, t, g, unknown or other
  modified_base (347)..(347): a, c, t, g, unknown or other
  modified_base (372)..(372): a, c, t, g, unknown or other
  modified_base (386)..(386): a, c, t, g, unknown or other
  modified_base (402)..(402): a, c, t, g, unknown or other
  modified_base (413)..(413): a, c, t, g, unknown or other
  modified_base (469)..(469): a, c, t, g, unknown or other
  modified_base (498)..(498): a, c, t, g, unknown or other
  modified_base (503)..(503): a, c, t, g, unknown or other
  modified_base (515)..(515): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttccctcgttgctcttttaagaggtgtccagtgtcaggtgaagctggtggagtcgtgggggagcgtggtccagcctgggagtccctgagactctcctgtgtagcgtctggattcaccttcaacngacatggcatgcacgtgggtcccnccaggctaccgaggcaagggctggagtggggtgcattnatggtatgatggaaaattaataatntactgtagattcgngaagggccattcaccntctcaagaganatacgaagacacaactatatctagaaatgaatagcctagacgagccgtaagggacncgggacttgtcttaccgtagtcgttgcgngaagngtgggggctggngggtaattcgaag

SEQ ID NO: 367399 - DNA, 671 bp, Homo sapiens
  misc_feature: GZ8MTXP01BS8H2.44.33.C11.1.454.CMB.2.raw
  modified_base (520)..(520): a, c, t, g, unknown or other
  modified_base (631)..(631): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctggttttcctcgttgctcttttaagaggtgtccagtgtcaggtgaagctggtggagtcgtgggggaggtcgtggtccagccgtgggacgtccctgacgactctccgtgtgtagcgtctggtacttcctaccttacaacagaactagtggcagtcgaccacggtcggggtccccaccggaacggtcccctaccggaacgggacgaaacgggggtacgtgggggtaagggttgggggttacgtacttaacttaagtacgttgggttaactggtaagtaagggtaaattaaagttaaaattacttaagtagtagtacgttaccgtagggacggtacgtacttcgaactctcacgagaataactataccgaaanaacactaatactagtaacggtaggtaaactacgtaatacgccgtagacggacgcgaacgacgacggtctgttaccgttattacgttgtaggtaacggagttggttacgggngggtacgttaacgggtgtaattaccgtaagttaacgtaag

SEQ ID NO: 367400 - DNA, 534 bp, Homo sapiens
  misc_feature: GZ8MTXP02G8171.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggagtccaatatcggatcttatcctgtcaactggtatcggggactcccaggccacggcccccgactcctatctatgctactaatcagccgccctcgacggggtccctgcccgtattccctctcgctccaagtctggcactacaggcctacctggccatccttgactctccagtctgaggatcgagctagtattactactgtgcagacagtgggatgacaggccggaacgcgtggggtgttcgggcgggaggactaagttcgagtcgtccgtaggtccacgcccgaaggcctcgcccccg

SEQ ID NO: 367401 - DNA, 508 bp, Homo sapiens
  misc_feature: GZ8MTXP02HUBNS.44.33.C11.1.454.CMB.2.raw
  modified_base (303)..(303): a, c, t, g, unknown or other
  modified_base (341)..(341): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagacatggcatgcactgggtccnccaggctccaggcaagggctggagtgggtggcacttanatggtatgatggaagtataaatattatgtagattccgtagaaggccgatcacatctcagagacaattcgaagaacacactatatctaggaaatgaatagctagagagccgagacacggctgtctactactgtcgcgagagagtggggctcggtggatacgagtatag

SEQ ID NO: 367402 - DNA, 517 bp, Homo sapiens
  misc_feature: GZ8MTXP02GZ3O7.44.33.C11.1.454.CMB.2.raw
  modified_base (306)..(306): a, c, t, g, unknown or other
  modified_base (347)..(347): a, c, t, g, unknown or other
  modified_base (371)..(371): a, c, t, g, unknown or other
  modified_base (380)..(380): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcaccttcaacagacatggcatgcactgggtccnccaggcctccgaggcaagggactgggagtgggtgcacttanatggtatgatggaaattaataatnttatgtagnttcgagaacgggcatcacatctccagagacaattacgaaagaacacactatatactaggaaatagaatagctagagagaccgagacacggctgtctactactgtcgcgagaagagtcgggctcggtaggactagaag

SEQ ID NO: 367403 - DNA, 524 bp, Homo sapiens
  misc_feature: GZ8MTXP02JI3C4.44.33.C11.1.454.CMB.2.raw
  modified_base (425)..(425): a, c, t, g, unknown or other
  modified_base (522)..(522): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggagcgtggtccagcctgggaggtccctgagactctcctgtgtagcgtctggattcaccttcaacagacatggcatgcactgggtccgcaggctccaggcaagggactggagtgggtgcacgttaatggtatgatggaaataataatattaatgtaagattccggtagaaagggccgattccaacatctccagagacaattcgaaaanaacacactatatatagaaatagaatagactagagacgacgagacacggtctagtactactactgtacgcgagaagagtacggcgtcgtacgacgtanag

SEQ ID NO: 367404 - DNA, 548 bp, Homo sapiens
  misc_feature: GZ8MTXP02HDGDM.44.33.C11.1.454.CMB.2.raw
  modified_base (368)..(368): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtctgggacccccgggcaggggtcaccatctcttgttctggaaggaagtccaatatcggatcttatcctgtcaactggtatcggggactcccaggcaccggccccccgatccttatctatgctactaatcagcgccctcgacggggtccctgcccgattcctctggctccaagtctcggcactacaggctaccnggccatcctgactctcagtctgagatgaggctgattactactgtgcagcagtgggatgacaggccggaacgcgtggggtgtcgggcggagggaccaggttcgaccggtcgtacggtcacggacccgaacggcctccgcccccgttcggtcctaccgtcctccggttcccccacccttccc

SEQ ID NO: 367405 - DNA, 565 bp, Homo sapiens
  misc_feature: GZ8MTXP02HT7UF.44.33.C11.1.454.CMB.2.raw
  modified_base (308)..(308): a, c, t, g, unknown or other
  modified_base (513)..(513): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggagcgtggtccagcctgggagtccctgagactctcctgtgtagcgtctggattcaccttcaaacagacatggcatgcacgtggggtcccnccaggcctcccgaggcaaaggggactgggagtggggtggctacgttatagtgggtaatgaattggaaagttaaataattaattatggtaacgtattccggtaggaaacggggccgaatttccgaacatctaccaagagaacaagttacgaaagaacaactactaatatactaggaaatgaaatagctagagagccgagacacggntgtactacgtactgtacgacgagaagagtcggggctggtacggattacgaag

SEQ ID NO: 367406 - DNA, 560 bp, Homo sapiens
  misc_feature: GZ8MTXP02IDMNH.44.33.C11.1.454.CMB.2.raw
  modified_base (309)..(309): a, c, t, g, unknown or other
  modified_base (509)..(509): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctctttaagaggtgtccagtgtcaggtgaagctgggtggagtcgtgggggaggcgtggtccagcctgggaggtccctgagactctcctgtgtagcgtctggattcaccttcaacagacatggcatgcactggggtcccnccaggcctcccgagggccgaaggggactgggaggtggggtgcaacttatatgggtatgataggaaagttaataatatttatagtaagtattccggtagaaagggcccgtatccacccatctccagagacaaattcgaaagaaacacactaatattgaaggaaatagaatagcctagagacgaccgtaaggctaacgggtntttacactactggtgcgaagaggaacgtggggctcggtaggactaagagaa

SEQ ID NO: 367407 - DNA, 529 bp, Homo sapiens
  misc_feature: GZ8MTXP02HYST7.44.33.C11.1.454.CMB.2.raw
  modified_base (348)..(348): a, c, t, g, unknown or other
  modified_base (372)..(372): a, c, t, g, unknown or other
  modified_base (416)..(416): a, c, t, g, unknown or other
  modified_base (425)..(425): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagacatggcatgcacgtgggtcccgcaggcctccgaggcaagggactgggagtgggtgcattanatggtatgatggaaagtaataatnttatgtagtattcgtagaacgggcctattcacatcctcagaganaatcgaaanaacacactatatctaggaaatgaatagactagagagaccgaggacacggtctaggtctacgtactgtcgacgagaagagtcggggactcggtaggactacgaag

SEQ ID NO: 367408 - DNA, 520 bp, Homo sapiens
  misc_feature: GZ8MTXP02IBAQK.44.33.C11.1.454.CMB.2.raw
  modified_base (380)..(380): a, c, t, g, unknown or other
  modified_base (421)..(421): a, c, t, g, unknown or other
  modified_base (471)..(471): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggtttcctcgttgctcttttaagaggtgtccagtgtcaggtgaagctggtggagtcgtgggggaggcgtggtccagcctgggagtcctgagactctctgtgtagcgtctggattcaccttcaacagacatggcatgcactcgggtccgccaggcctccgaggcaaaggggctgggagtgggtgctacttatagtggtatgatagggaaattaaataatattaangtagattcgagaaggcatcacatcacagagacaatacgaanaacacactaatatactaggaaatagaatagcctagagacgcgagacacgntcgctactactgtagcgagaagaggtcggggcctggtagaactacgaag

SEQ ID NO: 367409 - DNA, 554 bp, Homo sapiens
  misc_feature: GZ8MTXP02GHGJA.44.33.C11.1.454.CMB.2.raw
  modified_base (310)..(310): a, c, t, g, unknown or other
  modified_base (353)..(353): a, c, t, g, unknown or other
  modified_base (525)..(525): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggacggtccctgagctctcctgtgtagcgtctggattcaccttcaaacagacatggcatgcacgtgggtccnccaggcctccgaggcgaaagggctgggagtgggtgctacttanagtggtatgataggaaattaaataatattatagtagtattccgtaggaacgggccgtattccaaccatcctaccaagacgaactaaattacgaaaagaacaacactaatactactaggaaaatagaaatgactagaagacgaccgagacacggctgtactactactgtacgngagaagagtggggctggtaggactagaag

SEQ ID NO: 367410 - DNA, 509 bp, Homo sapiens
  misc_feature: GZ8MTXP02H7011.44.33.C11.1.454.CMB.2.raw
  modified_base (348)..(348): a, c, t, g, unknown or other
  modified_base (452)..(452): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaaacagacatggcatgcactgggtccgccaggcctccgaggcaaggggactggagtgggtgcattantggtatgatggaataatatattatgtagattcgagaggccgatcacatctccagagacaattacgagaacaacactatatctaggaaatagaatagctgaaagngaccgagacacggctgtactactactgtcgcgagaagagtgggctggtggatacgag

SEQ ID NO: 367411 - DNA, 557 bp, Homo sapiens
  misc_feature: GZ8MTXP02I3JYG.44.33.C11.1.454.CMB.2.raw
  modified_base (308)..(308): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggagtccaatatcggatcttatcctgtcaactggtatcggggactcccaggccaccggcccccgactccttanctatgctactaatcagccggccctcgacggggtccctcgcccgtattcctctgctccagtctggcactacaggcctacctggccattcccttgactcctcagtctgagatgagctgattactatgtgcagcagtggatgacacggccggaacggtcggtggggtcggttcgggacgggacggaccgtaaggttccgacccgttacgtaaggtccgaccggaccgaacggtcctccggcccccgtttcgg

SEQ ID NO: 367412 - DNA, 652 bp, Homo sapiens
  misc_feature: GZ8MTXP02JDEXR.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgccctcttaagaggtgtcatgtgtcaggtgcaattcgtggagtcgtgggggaggcgtggccccaggtagggggtccctgacgactctcctgtgcagcctctggattcaccttgataatggaatatgcagtggtccgcaggctccgaggccgaggggctggaggtgggtggcgaggtgtgtctatttcagtggaaggaatcgaagtcgtacgggtgtacgttccgtggacggtcctattccgacctactctaccgagacgtaacaacgttaccgaagaaacacgtagttacgtcttacgttacaaaagtacgaaacgacgtaccgtagaacgtacccgtacggaacggtaaccgacgggtacccgtttaggtttaacgtttttggacggtacgtacggttaacttacgttaccgttacgtttaaaccgtaaaacgtttccggttactacgtttcccggtaaccggtacccggttaacccggggg

SEQ ID NO: 367413 - DNA, 773 bp, Homo sapiens
  misc_feature: GZ8MTXP02JNZMC.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccggcgagggggtcaccatctcttgttctggaaggaagtccaatatcggatcttatcctgtcaactggtatcgggactcccgaggccaccggccccccgactccttatcctatcgctactaatcacgccggccctcgacggggtccctcgcccgtatttcccctcgtcggcctaccgaacgttccgtcggccaccgtacgacgggtcctaaccgtcggccctaagttcccttagaccttcccgtcccgtaagttcccgtaggtaacgggtacgttagggaacggtccgttaggtaaacctttaccgttaaaccgttggttcgaccgaggtaccgtaaggttacgggggaaattacgggaaccgaaccggggtaaccccggggaaaccggggtcggtttcggggggtttacggggtttcccgggggaaccgggggtaaacgggggtaaaccccggttaaaacggggttcccggtaacccccggggtttacccggtaacgggttacccggaacccggtacccccggtaaacggggtccccgttacccccggtaccccccggtttacccgggg

SEQ ID NO: 367414 - DNA, 529 bp, Homo sapiens
  misc_feature: GZ8MTXP02F7AU8.44.33.C11.1.454.CMB.2.raw
  modified_base (404)..(404): a, c, t, g, unknown or other
  modified_base (415)..(415): a, c, t, g, unknown or other
  modified_base (448)..(448): a, c, t, g, unknown or other
tcagacagtatatacacgaccggtgctcgatttagagtgagctcgttgggtttggggggtcccaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgacattggtggttataactttgtctcctggtaccaacaccaccaggcaaagcccccaaattcatcatttatgatgtcagtaagcggcctcaggggtccctgatcgcttctcctgctcaagtctggcacacggcctccctgacccgtctctgggctccaggctgaggatgaggntgactatttcngtctcctcatatcgcaggcgaacgtaggtttangttacttcgggaacttcggggacctaggtccaaccgtcctacgtcacgtccaacggcccaacccactcgcctactctcccg

SEQ ID NO: 367415 - DNA, 602 bp, Homo sapiens
  misc_feature: GZ8MTXP02GWLXS.44.33.C11.1.454.CMB.2.raw
  modified_base (232)..(232): a, c, t, g, unknown or other
  modified_base (296)..(296): a, c, t, g, unknown or other
tcagacagtatatacacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtnactattggtgttatacttgtctctgtaccacaccaccagacaacgccccaaattcatcatttangatgtcagtacgccgcctcgagggtccctgactcgcttcctctggtctcaagtctggccaacgaccggtcctcccgtgaccgtctcgcggcctccgagctaggaggatgggagctagtacttagttctcgtccttcctacagttacgtggaccgtaaggtccgtaacgttaaggttttctacggttccgtttaccgggaaacgttcgggtaaacctaaccgggttcctaacccgttacgttacccggtacaaccggaaccccgaacggtacccctaaacccctcgtaccgtacctaccgtttcccg

SEQ ID NO: 367416 - DNA, 603 bp, Homo sapiens
  misc_feature: GZ8MTXP02FUCI3.44.33.C11.1.454.CMB.2.raw
  modified_base (332)..(332): a, c, t, g, unknown or other
  modified_base (375)..(375): a, c, t, g, unknown or other
  modified_base (429)..(429): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcggggacccccgggcgaggggtcaccatctcctgcacgtgggagcagatccaacatcgggacagattctgatgtccactggtaccaacaccttccaggaacacgcccccaaactcctcatctttggtaacaactatcggcctcaggggtcccngaccgattctctggctcccaacgtctggcacctcagccctccnggcactcacgtgggcctccaggcctgaaagatggagggtgtaattagtttaccngcctacgtacctagtcgacacgacacgtccgtgtagggttggggtttggggtcggttcggggacggggaacgggaacccgaggtcgtaccggtacccggttcggtcgggtaccgaccggtacccggaacggtcccgtacccggtcccccgtcggtacctaccgttccgttcccg

SEQ ID NO: 367417 - DNA, 528 bp, Homo sapiens
  misc_feature: GZ8MTXP02JYY9H.44.33.C11.1.454.CMB.2.raw
  modified_base (346)..(346): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaacagacatggcatgcactgggtccgccaggctccgaggcaagggactgggagtgggtgcacttanatggtatgatggaataataatatatgtagattccgtgaagggccattcaccatctcagagacaattcgaaagaacacactatatctaggaaatgaatacgacctgaagacgccgaagggacacgggctagtacctaacgtactgcgaggagaagacgtgggggctcggtaggacttacgaag

SEQ ID NO: 367418 - DNA, 545 bp, Homo sapiens
  misc_feature: GZ8MTXP02GSDXS.44.33.C11.1.454.CMB.2.raw
  modified_base (426)..(426): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggaagtccaatatcggatcttatcctgtcaactggtatcggggactcccaggccaccggcccccgactccttatctatgctactaatcagcgccctcgacgggtccctgcccgtattccctcgtcggctccaagtcgtggccactacgaggcctaccgtggcctatcccttgactctccagttcgtagagntgagctgtattactactgtgctagcagtggatgacgcgacggacgcgtgggtcgtcgggcgggacggtacgacgttcgacccgttcgaaggtcgacgacccgagcctccgcccgtccgg

SEQ ID NO: 367419 - DNA, 572 bp, Homo sapiens
  misc_feature: GZ8MTXP02JBTWF.44.33.C11.1.454.CMB.2.raw
  modified_base (193)..(193): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcgggacccccgggnaggggtcaccatctcttgttctggaaggaagtccaatatcggattcttatcctgtcaactggtatcggggactcccaggcaccggccccccgatcccttatctatgctactaatcagccgccctcgacggggtccctgcccattctctcgctccaagtctgcactacaggctacctcgccatcctgactccttccagtcttgagagtgaggctgtattactacgtgtgcagacgatgggatagacgagggaccggaacggcgtgggtggttcgggacgggtacggacgaagttcggacccgttacgtacgggtcacggcccgaaacggtccgtccggccccgtcggtacctaccgtccgtccgttccccacctttaccc

SEQ ID NO: 367420 - DNA, 628 bp, Homo sapiens
  misc_feature: GZ8MTXP02JGWQ7.44.33.C11.1.454.CMB.2.raw
  modified_base (311)..(311): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggaggcgtggtccagccgtgggagtcctgagctctctgtgtagcgtctggattccaccttcaaacagacatggcagtgcacgtcgggtccnccgaggcctccgaggcgaaaggggctgggacggtgggcgctaagttatagtggtatggaatagggaaaattaaatatattagtagtagtattacggaggaacgggcctattccaccgtatcctacgaagacgtaactaaagttaccgaaaagaaacctaactaaacttaataacttacgtaaagggtaaaatagaaaattacggaccgtaggaacggaaccggaccggaaggaaccgaccgggtctacggtaccttaaactcgttaggacgacggtaaggaaggtacggtcgggggtacctaggtaggaactagaag

SEQ ID NO: 367421 - DNA, 576 bp, Homo sapiens
  misc_feature: GZ8MTXP02HWFK5.44.33.C11.1.454.CMB.2.raw
  modified_base (289)..(289): a, c, t, g, unknown or other
  modified_base (335)..(335): a, c, t, g, unknown or other
  modified_base (399)..(399): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtctggggacccccgggcaggggtcaccatctcttgttctggaaggaagtccaatatcggatcttatcctgtcaactggtatcggggactccaggcaccggcccccactccttanctatgctactaatcagccgccctgacggggtccctgcccgtattcnctggctccagtctcggcactacaggtctaccgtggcctattccttgacttctcccgtagttccngaggatggaggctgtatttactactgtgcagcagtgggatgacacgggaccggacggtcgtaggggtggtcgggacgggacgggactaagggttcgtaccggtacgtacggtcgacggcccgtaacggtcgtcccgtccccgtcggtcctacgtccgttcccgtcccctacccttcc

SEQ ID NO: 367422 - DNA, 559 bp, Homo sapiens
  misc_feature: GZ8MTXP02I0YXR.44.33.C11.1.454.CMB.2.raw
  modified_base (307)..(307): a, c, t, g, unknown or other
  modified_base (376)..(376): a, c, t, g, unknown or other
  modified_base (454)..(454): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagactctcctgtgtagcgtctggattcaccttcaacagacatggcatgcacgtgggtccncaggctccgaggcaagggctgggagtggggtgcacttatagtggtatgataggaaacgttaaataagtntttaatgtaacgtatttccggagggaaacggggtcccgtaattcaaccctatctacccaagagaactaattacgaaanaacaacaacttactatacgtaggaaattagaaatagacctagaagagaccgagacacggctgtactactactgtagcgagaagagtcggggctggtagactagag

SEQ ID NO: 367423 - DNA, 568 bp, Homo sapiens
  misc_feature: GZ8MTXP02F4LLP.44.33.C11.1.454.CMB.2.raw
  modified_base (340)..(340): a, c, t, g, unknown or other
  modified_base (347)..(347): a, c, t, g, unknown or other
  modified_base (352)..(352): a, c, t, g, unknown or other
  modified_base (367)..(367): a, c, t, g, unknown or other
  modified_base (375)..(375): a, c, t, g, unknown or other
  modified_base (381)..(381): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggcctggggaggtccctgagactctcctgtgtagcgtctggattcaccttcaacagacatggcatgcactgggtccgccaggcctccgaggcaagggctggagtgggngcattantgtangatggaaataatatnttatgtanattcgngaagggccattcacatcctacagacgaacaagttacgaaagaacaacactaattatactaggaaattgaaatagacctaggaagacggaccggaggaccacgggcttaggtaccttaaccgtacgttcggagaccgtaaggaaggtaggttcgggggaccttagggtagggtaacttaacggaaagg

SEQ ID NO: 367424 - DNA, 540 bp, Homo sapiens
  misc_feature: GZ8MTXP02I4BR4.44.33.C11.1.454.CMB.2.raw
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtctgggaccccccgggcagggggtcaccatctcttgttctggaaggaagtccaatatcggatcttatcctgtcaactggtatcggggactcccaggcacggccccccgactccttatctatgctactaatcagcggccctcaggggtccctgcccgattctctggctccaagtctggcactacaggctacctggccatccttgatctcagtctgagatgaggctgattactactgtgcagcagttggggattgacgaggccggaaacggcgtggggtcgttcgggcggagggaccaaggttcgaccgtccgtaggtcgacgcccgaaggctacggccccagtcggtcacttctcgttccctaccc

SEQ ID NO: 367425 - DNA, 506 bp, Homo sapiens
  misc_feature: GZ8MTXP02H1D94.44.33.C11.1.454.CMB.2.raw
  modified_base (281)..(281): a, c, t, g, unknown or other
  modified_base (306)..(306): a, c, t, g, unknown or other
  modified_base (346)..(346): a, c, t, g, unknown or other
  modified_base (372)..(372): a, c, t, g, unknown or other
  modified_base (398)..(398): a, c, t, g, unknown or other
  modified_base (497)..(497): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtgagtcgtgggggagcgtggtccagcctgggagtccctgagactctctgtgtagcgtctggattcaccttcaacngacatggcatgcacgtggggtcccnccaggcctacgaggcaaagggctgggagtgggtgcattanagtggtatgatggaataatatattangtagattcgagaagggcatcacatcncagagacaaattcgaagaacacaactatatactaggaaatgaatagctagagagcgagacacgctgtactactactgtgacgagaagagtggggctggnggactagag

SEQ ID NO: 367426 - DNA, 625 bp, Homo sapiens
  misc_feature: GZ8MTXP02JMUSF.44.33.C11.1.454.CMB.2.raw
  modified_base (287)..(287): a, c, t, g, unknown or other
  modified_base (316)..(316): a, c, t, g, unknown or other
  modified_base (390)..(390): a, c, t, g, unknown or other
  modified_base (399)..(399): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcggtggtccaggcccgtggggacggtccctgacgactctcctgtgtagcgtctggattcaccttnaacagacatggcatgccacgtgggtcccnccaggcctccgaggcaaaggggactgggaggttggggtgctattagagtggtatgaagtaggaaattaataatnttatgtagnttcgagacggcgattacacatctaccagtacgaacaaacgttacgaaaacgaactaaacaacttaaattaacttacgtaagggtaaaataggaaaactacggtaccaggaacggacggacccggaaaggaaccgacgggacttacggtacctaacgttaacgtcggtacggacggaaggtaaggtaggtacgggggtcgtaccggtacggtaaacgttacgtaaag

SEQ ID NO: 367427 - DNA, 651 bp, Homo sapiens
  misc_feature: GZ8MTXP02JGNRI.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggacccccgggcgacgggggtcaccatctcttgttctggaaggaagtccaatatcggatcttatcctgtcaactggtatcgggactcccgaggccaccggcccccgactcctatctatgctactaatcagccgccctcgacgggtccctcgcccgtattcccctctcggcctaccaagtcgtcgggccaaaccgaccggtcccttcccgtcgtacccgtctccgtcggggcctcccgaggcctaggaccgtatcgggaacggtcgttagtaatttacgtttagtttggtttcgcttcgtaagtgttcggtttccgtcgctattcctaactttagtcgttacgttacgggaaggttacggggaacctaaacgggttcccaacccggttaccgtaggtaccgaaccggacccccgaaacgggtcccccaaaaccccgtcgttccgacctaacccg

SEQ ID NO: 367428 - DNA, 510 bp, Homo sapiens
  misc_feature: GZ8MTXP02GEWZQ.44.33.C11.1.454.CMB.2.raw
  modified_base (307)..(307): a, c, t, g, unknown or other
  modified_base (343)..(343): a, c, t, g, unknown or other
  modified_base (365)..(365): a, c, t, g, unknown or other
  modified_base (377)..(377): a, c, t, g, unknown or other
  modified_base (490)..(490): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggcctgggaggtccctgagactctcctgtgtagcgtctggattcaccttcaacagacatggcatgcactgggccncaggctccgaggcaagggctggagtgggtgcattanatggtatgatggaataataatntatgtagatcgngaaggcattcacatctcagagacaatcgaaagaacacactatatcaggaaaatgaaatagacctagaagacgaccgaggacacggctagtctactactgtacgcgagaagagnggggctcggtggatacgaag

SEQ ID NO: 367429 - DNA, 591 bp, Homo sapiens
  misc_feature: GZ8MTXP02FYE0T.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcacgggggtcaccatctcttgttctggaagagtccaatatcggatcttatcctgtcaactgtatcggggactcccaggccaccggccccccgactccttatctatgctactaatcacgccggccctcgacgggtccctgccccgtattccctctcggctccgaagtctggccactacaggtcctaccgtcggcctacttccttgacttcctcctagtcttagacggtatgaggctgtacttacgtactgtgactagctaagtgggatgaacgacggaccggaacgggcggtacgggtcggttacggggcgggaacgggacgtacgttacggacccgttacgaacggttccgacggtacccgacggcctccggcccccgttccgg

SEQ ID NO: 367430 - DNA, 577 bp, Homo sapiens
  misc_feature: GZ8MTXP02GSEGQ.44.33.C11.1.454.CMB.2.raw
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtctcggggacccccgggcaggggtcaccatctcttgttctggaaggagtccaatatcggatcttatcctgtcaactggtatcgggactcccaggcaccggcccccgactccttatctatgctactaatcagccgccctcgacggggtccctggcccgtattctctcggctccgaagtctcggcactacaggctaccgtggccctatcccttgacttcctcctagtctcgaggtactgaggtctgtacttactacgtgtcgcagcagtggatagacaggccggaaggcgtggggtcgttcgggcggtaacgggacctaaggttcgacccgttcgtacggtcacggacccgaacggcctccggcccccgtcggtcctacgttcctccgttccccacccttcccg

SEQ ID NO: 367431 - DNA, 685 bp, Homo sapiens
  misc_feature: GZ8MTXP02II6EG.44.33.C11.1.454.CMB.2.raw
  modified_base (309)..(309): a, c, t, g, unknown or other
  modified_base (420)..(420): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagctctctgtgtagcgtctggattcaccttcaacagacatggcatgccacgtcggggtcccnccgaggccctacccgagggaccgaaaggggaccttggggaaggtgggggtagacctaaacgtttagtagttaggggttatggaagttaggggaaaatttaaataaagtttntttaagtaggttaagtacgtttccggagggaaacgggtcccgtaattcccgaacctattcctacccgaagacgaacctaaagttaccggaaaacaaccaaactaaccttaaattacgttacgtaagggtaaaataggaaatacgacccgttaggaaacggacggacccggaaggaaccgtacgggtacttaggtaccttaaacgtacgtggttaccgacgaaggaaggtaggtcggggtaccttacggtaggtaaactacgaagg

SEQ ID NO: 367432 - DNA, 497 bp, Homo sapiens
  misc_feature: GZ8MTXP02GPONF.44.33.C11.1.454.CMB.2.raw
  modified_base (358)..(358): a, c, t, g, unknown or other
  modified_base (415)..(415): a, c, t, g, unknown or other
  modified_base (436)..(436): a, c, t, g, unknown or other
tcagacagtatatacacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcatggcaccagcagtgacattggtgttataacttgtctctgtaccaacaccaccagacaaagccccaaattcatcatttatgatgtcagtaagcggccctcgagggtccctgactcgcttcctctggctccaagtctggcaacncggcctcctgaccgtctcgtggctccgagctgagatgagctgactattctgctcctnatatgcaggcactaggtttangtcttcggaactggaccaagtcacgtctacgtcacgccgaacgccaacccgatcgtcactc

SEQ ID NO: 367433 - DNA, 520 bp, Homo sapiens
  misc_feature: GZ8MTXP02GDBNH.44.33.C11.1.454.CMB.2.raw
  modified_base (297)..(297): a, c, t, g, unknown or other
  modified_base (517)..(517): a, c, t, g, unknown or other
tcagacagtatatacacgaccggtgctcgatttagagtgagctcgttgggtttgggggttctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgacattggtgttatacttgtctctgtaccaacaccaccaggcaaacgccccaaattcatcatttangatgtcagtaagcggccctcgaggggtccctgatcgcttcctctgctccaagtctggcaacacggcctccctgaccatctctgggcctccaggctgaggacgaggctgattacactgcagctcatatacaagcagcagccaccccttatcgtcttacggaaactggggaaccaagggtccaccggtcctaaggtcacggcccaaaggcccaaaccccctntcg

SEQ ID NO: 367434 - DNA, 529 bp, Homo sapiens
  misc_feature: GZ8MTXP02G5S3T.44.33.C11.1.454.CMB.2.raw
  modified_base (305)..(305): a, c, t, g, unknown or other
  modified_base (341)..(341): a, c, t, g, unknown or other
  modified_base (366)..(366): a, c, t, g, unknown or other
  modified_base (374)..(374): a, c, t, g, unknown or other
  modified_base (382)..(382): a, c, t, g, unknown or other
  modified_base (428)..(428): a, c, t, g, unknown or other
  modified_base (498)..(498): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccaggcctgggagtccctgagactctcctgtgtgcgtctggattcaccttcaaacagacatggcatgcatgggtccnccaggctccaggcaagggctggagtgggtgcattanatggtatgatggaaattaataagtnttatgtanattccggngaacgggcctattccacatctcagagactaattacgaaagaacaanactaatatacaggaaatagaatagctagagagacgagacgacgctagtactaactactcgtagcgaaggngtagtcggggtactcggtaggacttacgaag

SEQ ID NO: 367435 - DNA, 589 bp, Homo sapiens
  misc_feature: GZ8MTXP02FS7CM.44.33.C11.1.454.CMB.2.raw
  modified_base (318)..(318): a, c, t, g, unknown or other
  modified_base (349)..(349): a, c, t, g, unknown or other
  modified_base (425)..(425): a, c, t, g, unknown or other
  modified_base (464)..(464): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggaccccccgggcgagggggtccaccgatctcttgttctggaaggaagtccaatatcggatcttatcctgtcaactggtatcggggactcccgagccaccggccccccgatccttatctangctactaatcagccgccctcgacgggtcccngcccgtattccctctcggctccaagtctggcactacgaggctacctcggacacttcccttgacttctccagttcgnggagtatggaggtctggtaacttactacgtgtgcacggngtagtggggatcggaacgacggaccgggtaacggcgttcgggggtcgttcggggacgggtaggtaaccgtagtccggaccgtccgtaaggtccacggaccgaaggccttccggccccgtttacgg

SEQ ID NO: 367436 - DNA, 595 bp, Homo sapiens
  misc_feature: GZ8MTXP02GI32Y.44.33.C11.1.454.CMB.2.raw
  modified_base (268)..(268): a, c, t, g, unknown or other
  modified_base (307)..(307): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgcaattcgtggagtcgtgggggaggcgtggccccaggtagggggtccctgagactctcctgtgcagcctntggattcaccttcgataattggaatatgcagtgggtccncaggctccaggcgaggggctgggagtggggtgcaggtgtgtcatttcagtggagaaatcaagttctacggtgattccgtgagggcctaattccaccatcctaccagagaacaacttaccgaagaacacagtgtctacttacaaatgaaacagacctagacgacctacgacggacacggtccgttagttaacgtttttggtcgtcgtaagtaccttattaccttacggtttaaccctaaaagttccggttaactacgtttaccgaaccggtccgttcggggtaccccgg

SEQ ID NO: 367437 - DNA, 541 bp, Homo sapiens
  misc_feature: GZ8MTXP02G6LOL.44.33.C11.1.454.CMB.2.raw
  modified_base (306)..(306): a, c, t, g, unknown or other
  modified_base (355)..(355): a, c, t, g, unknown or other
  modified_base (503)..(503): a, c, t, g, unknown or other
  modified_base (516)..(516): a, c, t, g, unknown or other
  modified_base (530)..(530): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttcaaacagacatggcatgcacgtcggggtcccnccgagggcctccgaaggccaaaggggctgggagtggggtgctactttanagttggtatgataggggaaataataaatattatgttaagattccgaggaacgggccattccacatctacagagacaattacgaaagaacactactaatatactaggaaatgaatagcctagacgagccgaaggacacggctagcttanactgtcgacgagngagtgggctacggngacacagatag

SEQ ID NO: 367438 - DNA, 655 bp, Homo sapiens
  misc_feature: GZ8MTXP02GDWC2.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggacccccgggcgagggggtcaccatctcttgttctggaaggagtccaatatcggatcttatcctgtcaactggtatcggggactcccgaggccaccggcccccgactccttatctatgactactaatcagccggccctcgacggggtcccctgccccgtatttccccgtctcggtcctaccgtaaggttcctgggcctaactaacgacgggccttacccgtggccctatcccttgactcctccagtctagaggtatggaggctagtaacttactacgtgtcgactagcaggttagggactcggaacgacgggaccggggtaacggtcggttcgggggttcggttcggggacgggggaacgggtacccgtaaacgggttccggaacccggtaccggttaacgggtacgaaccggacccgtaacccccgggcgttaccccggcccccgtttacccggg

SEQ ID NO: 367439 - DNA, 591 bp, Homo sapiens
  misc_feature: GZ8MTXP02I8DNT.44.33.C11.1.454.CMB.2.raw
  modified_base (372)..(372): a, c, t, g, unknown or other
  modified_base (381)..(381): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtctcgggacccccgggcgagggggtcaccatctcttgttctggaaggagtccaatatcggatcttatcctgtcaactggtatcgggactcccaggccaccggcccccgactccttatctatcgctactatcacgccgtcctcgacgggtccctgcccgtattcctctgctccgagtccgngcactacgnggtcctaccgtggcctattcccttgtactcctcgtacgtcgttggacggtagtagacggcgtacgtactttacgtacgtggtcgacgacgtcgagttgggactcgacgacggaccggaacggtcgtaggggtcgtacggggcgggaacggtacgtacgttacgaccgttaccgtaagtacgacgaccgaacggcctcccgtcccgtccgg

SEQ ID NO: 367440 - DNA, 559 bp, Homo sapiens
  misc_feature: GZ8MTXP02H40K0.44.33.C11.1.454.CMB.2.raw
  modified_base (257)..(257): a, c, t, g, unknown or other
  modified_base (266)..(266): a, c, t, g, unknown or other
  modified_base (277)..(277): a, c, t, g, unknown or other
  modified_base (302)..(302): a, c, t, g, unknown or other
  modified_base (342)..(342): a, c, t, g, unknown or other
  modified_base (373)..(373): a, c, t, g, unknown or other
  modified_base (514)..(514): a, c, t, g, unknown or other
  modified_base (558)..(558): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgaccttgggtttttctcgttgcttcttttaagaggtgtccagtgtcaggtgaagctggtggagtcgtgggggagcgtggtccagccgtgggacggtccctgagctctctgngtagcgtcnggatcaccttnaacagacatgcatgcacgtcggccncaggcctccgaggcaagggctgggagtgggtgctagttangtgtatgagtaggaaataataaattattagngtaatacttccgagaacgggctattaccacattccacaagacgtaaactaacttacgaaagaaacccataactaataactgtaaaggtaaataagatacgagtagacgacggacgaacgacgacgtctcgtactacgtacnggtacgagagtaggaggtcgggactaggtacgatacgagttaang

SEQ ID NO: 367441 - DNA, 575 bp, Homo sapiens
  misc_feature: GZ8MTXP02G0BZ8.44.33.C11.1.454.CMB.2.raw
  modified_base (352)..(352): a, c, t, g, unknown or other
  modified_base (379)..(379): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctcctgtgtagcgtctggattcacccttcaaacagacatggcatgcacgtgggtcccgccaggcctaccgaggcaaggggctgggagtgggtgctattanatggtatgataggaaagttaaataatnttaatgtagattccgtagaaacgggtcctattccgaacatctaccaagacgaactaaatacgaaagaaaccactaaactaatatacgtagaaaatagaaatacgcctagaacgacgaccggaagacgacggtctacgtactaacgtacgtgtacgacgaagaaggtaggtagggggctacggtggacttaacgaag

SEQ ID NO: 367442 - DNA, 527 bp, Homo sapiens
  misc_feature: GZ8MTXP02JYV6L.44.33.C11.1.454.CMB.2.raw
  modified_base (307)..(307): a, c, t, g, unknown or other
  modified_base (347)..(347): a, c, t, g, unknown or other
  modified_base (478)..(478): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggaggtccctgagactctcctgtgtagcgtctggattcaccttcaaacagacatggcatgcactgggtccnccaggcctcgaggcaaggggctggagtgggtggcacttanagtggtatgatggaataataatatatgtagattcgtagaagggccgtattcacctatctcccagagacaattacgaagaacacactaatatactaggaaatagaatagactagagagaccgaggacacggntgtactactactgtcgacgagaagaggtcggggctacggtgactacgag

SEQ ID NO: 367443 - DNA, 574 bp, Homo sapiens
  misc_feature: GZ8MTXP02GQA46.44.33.C11.1.454.CMB.2.raw
  modified_base (275)..(275): a, c, t, g, unknown or other
  modified_base (302)..(302): a, c, t, g, unknown or other
  modified_base (345)..(345): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttnaacagacatggcatgcacgtgggtccnccaggcctccgaggcaaaggggctgggagtggggtgctattanagtggtatgataggaaattaaataaattattagtcgtaagtacttccggtagaaacggggtccattccactatctacgagagaactaagttacgaaagtaacacacttaatatacgtaggaaatggaaatagacctaggaacgacggaccggaaggaccaacgggtctacgtactaccgtacgtcggacggacgagaggaggtcgggctaggtacgaatacgagtatag

SEQ ID NO: 367444 - DNA, 713 bp, Homo sapiens
  misc_feature: GZ8MTXP02IGA5W.44.33.C11.1.454.CMB.2.raw
  modified_base (267)..(267): a, c, t, g, unknown or other
  modified_base (311)..(311): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctgttgctcttttaagaggtgtccagtgtcaggtgaagctggtggagtcgtgggggagcgtggtccagccgtgggacgtcctgagactctctgtgtagcgtcnggattcaccttcaaacagacagtggcatgcacgtcggggtcccncaggcctacccgaggcgaaaggggacttggggaggttggggtaggacctaacgtttatagttaggggtaatggtaagttaggggaaaattaaaacttaaatttatttaaagtagttaacgtaacgttttcccggaaaggaaaccggggcccttaattacccaaaccctaatttccctacccgaagaaacgtaacctaaaagttacccgggaaaaacgaaacctaaactaaactttaaataacgttacgtaaaggtaaaagtacgtaaagtacgtaccgtaaggaacggacggaccgggaaacggaaccgtacggtacttacggtaccttaaccgtacgttacggtacgaacggaggtaacggtacgggtcggggtaccgtacggtacggaacttaacggaag

SEQ ID NO: 367445 - DNA, 687 bp, Homo sapiens
  misc_feature: GZ8MTXP02IG8SF.44.33.C11.1.454.CMB.2.raw
  modified_base (304)..(304): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggtttcctcgttgctctttaagaggtgtccagtgtcaggtgaagctgggtggagtcgtgggggagcgtggtccagcctgggagtccctgagctctcctgtgtagcgtctggattcacttcaacagacatggcatgcacgtcgggtccnccaggcctaccgaggacaaggggactggggacgtggggtgcctaagttatacgtgggtatgtaagtaggaaaagttaaattaagtctttaagtaggttaacgtacgttttcccgggaagggaaacggggtcccgtaattccaaaccctattaccctacccgaagaacggtaaactaaacgttaccggaaaagaaaccaaactaaacctaataacgttacgtaagggaaaacttagaaacgttaacgaccgtaggaacggaacggacccggaaaggggaacccgtacgggtacgttacggttaccttaaaccgtaacgtggtacggacggaaaggaacggtaacggtcgggggtacttaccgggtacgggtaactacgtaaagg

SEQ ID NO: 367446 - DNA, 676 bp, Homo sapiens
  misc_feature: GZ8MTXP02G43P0.44.33.C11.1.454.CMB.2.raw
  modified_base (638)..(638): a, c, t, g, unknown or other
  modified_base (665)..(665): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggacggcccctgagactctcctgtgtagcgtctggattccaccttcaaacagacatggacatgccacgtcgggtcccgccgaggcctccgaggcgaagggctgggagtggggtgctacgttatagtggtatggaattagggaaaagttaaattaagttatttaagtaggttaagtactttacccgggtagggaaacgggggtccctaatttaccgaaccctaagttccctaacccgaaggtaacggtaaactaaacgtttaaccggaaaacgaaaacctaaacctaaccttaaaattacgttaccgttaaaggtaaaagttagaaaacgttacgacccgtaggaacgacgggacccggaaagggaccgaacgggtctaggtacctacgttacgtgtacgngtaaggaagtaggtcggggcttacggnggaactagaag

SEQ ID NO: 367447 - DNA, 663 bp, Homo sapiens
  misc_feature: GZ8MTXP02JAG1S.44.33.C11.1.454.CMB.2.raw
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcggggacccccgggcgagggggtccaccatctcttgttctggaaggaagtccaatatcggatcttatcctgtcaacgtggtagtcgggacctcccgaggccaccggccccccgactccttatctatgctactaatcagccgccctcgacggggtccctcggcccgtattcctcgtcggcctccgaagtcctcggccactacgacggtcctacccgttggcctactcccttgacttcctaccagttcctagaggtactggacggtcttagtactttacgtacgtgtcgcgagtcaagtgggatacggacgacgggacccggaacggtcggttaggggtcggttacggggacgggtaacgggtacgtaaggttccggaccggttacgtacgggtaccaaccggacccgaacggggtccctacccggtcccccgttcgggtacccttaccgttcccggtttcccgttacccccttacccgtttaccc

SEQ ID NO: 367448 - DNA, 654 bp, Homo sapiens
  misc_feature: GZ8MTXP02GH2SP.44.33.C11.1.454.CMB.2.raw
  modified_base (304)..(304): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctggggagtccctgagactctcctgtgtagcgtctggattcaccttcaacagacatggcatgcacgtgggtccnccagggcctccgaggcaaggggctgggagtggggtggctacgttatagtggtatgatgggaaaagttaaataaaattattagtgtaaagtagtttcccgtagggaaacggggtccctaagtttaccaacctattaccctacccaaaggaacgaactaaagttacggaaaagtaaaccaactaacttaaattaacgtacctaaaggggaaaattggaaaatagaacccttaggaaggacgaccggaagggaaccgaccgggtctacggttacctaacgttaactcggttagaccgaaggaacggtaaggtcgggggtactcggggttagaacgttaacgagtaacgttaag

SEQ ID NO: 367449 - DNA, 624 bp, Homo sapiens
  misc_feature: GZ8MTXP02JED87.44.33.C11.1.454.CMB.2.raw
  modified_base (280)..(280): a, c, t, g, unknown or other
  modified_base (307)..(307): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgagactctcctgtgtagcgtctggattcaccttnaacagacatggcatgcacgtgggtccncaggcctaccgaggcaaggggactggggagtggggtgactacgtttatacgtggtatgattgggaaattaataattattagtgtagtatttccggtaggaacgggcctagttccaacctatcctacccgagacgaactaaagttcgaaaacgaaactaacaacttaataacttacgtaagggaaaattagaaagttacgaccgttaggaagacggaccggaaaggaccgacggtacgtaggtacctaacgttaccgttggtacgacggaaggtaaggaaggttcgggggtacctacggtagggtaacttacgaaagg

SEQ ID NO: 367450 - DNA, 702 bp, Homo sapiens
  misc_feature: GZ8MTXP02JTOS2.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagccgtgggacgtccctgagactctcctgtgtagcgtgtggacttccaccttcaacagacagtggcagtgacctacgtcggggtacccgccgaggccctaccgaagggaccgaaaggggtaccgttggggacggttggggtcggacctaacgtttagtacgtgggtatggaacgttaagggtaaaagttaaagttaaatttagtttaagttacggttaagtaacgtttacccggggtagggtaaacggggacccgttaatttacccgaaccctaacgttcccgtaacccgaaaggtaacggtaaactaaaacgttaaccgggaaaacgaaacctaaacaaaccttaattaactacgtaaggaaagtagaaatacgcgtaggacggagacccggaagacccgtacgcgttacgtaccctagtacgtcgtagacgtagaaggtcggtggggtactacggtcggtaatacgaag

SEQ ID NO: 367451 - DNA, 646 bp, Homo sapiens
  misc_feature: GZ8MTXP02JNEVB.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggaggcgtggtccagccgtgggagtccctgagctctctgtgtagcgtctggattcaccttcaaacagacatggcatcgccacgtcgggtacccaccgaggcctaccgaggacgaaggggacgtgggaggtggggtcgacctagtttatagtggtatagagtaggaaagttaaataagttattagtaggtaagtagtttaccggtaggtaaacggggcctaattaccaaccctagtacctaccgaagacgaactaaagttaacgaaacgaaactaacctaacttaatactacgtaagaaatacgaaatacgaccgtagaacgacgaccggaaggaccgacggtacgtagttacctaccgtacgttggtaccggtagaaggtaaggtagggtacggggtcgttaccggggtaggaaacgtacgtaaagg

SEQ ID NO: 367452 - DNA, 549 bp, Homo sapiens
  misc_feature: GZ8MTXP02IMQDL.44.33.C11.1.454.CMB.2.raw
  modified_base (347)..(347): a, c, t, g, unknown or other
  modified_base (375)..(375): a, c, t, g, unknown or other
  modified_base (441)..(441): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctgggtggagtcgtgggggaggcgtggtccagccgtgggacggtccctgagactctcctgtgtagcgtctggattcaccttcaacagacatggcatgcactggggtcccaggcctccaggcaagggactggagtggggtgctacttanagtggtatgatgggaaataattaaaatnttatagtagtattcccggtagaacgggcctaattcaaccatctccagaacgactaattaccgaaanaacacaactaatatagaagtaaatagaatacgctagagacgacgagacgacgtctacgtactactacgtgcgacgagagaggtgggactacggagaatacgtagatag

SEQ ID NO: 367453 - DNA, 651 bp, Homo sapiens
  misc_feature: GZ8MTXP02JIOQR.44.33.C11.1.454.CMB.2.raw
  modified_base (268)..(268): a, c, t, g, unknown or other
  modified_base (285)..(285): a, c, t, g, unknown or other
  modified_base (310)..(310): a, c, t, g, unknown or other
  modified_base (359)..(359): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggggagcgtggtccagccgtgggagtccctgagctctctgtgtacgcgtcnggattcaccttcaaacngacatggcatgccacgtgggtcccnccaggctaccgaggcgaaggggctggggacgtgggtgcctaacgtttanacgtggtatgaatagggaaagttaaactaagttattagtacggtaaatagttttacccggagggtaaacgggtacccgtagtttacccaacctactacccgtacccgaagacgtaaactaacgttacgaaaacgtaaacaacaaacttataacgttcaaggtaaattagaaacgtagacccgttagaacggacgaaccggaggaaaccgacggtaccgttaggtacctaacttaccgtagtacggaccgaaggaagaaggttacgggggctcggtacggtaagtactaaagg

SEQ ID NO: 367454 - DNA, 601 bp, Homo sapiens
  misc_feature: GZ8MTXP02JU6K3.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcggtggtccagcctgggaggtccctgagactctcctgtgtagcgtctggattccaccttcaacagacatggcatgcacgtgggtccgccaggcctccgaggcgaagggctgggacgtgggtggcacgttatagtgtatgataggaaagttaataaagttattaagtgtaacgtagtttcccggtaggtaaacggggcccgtaatttacccaacctaactccgtacccgaagtaacgaactaaacgttacgaaacgaaacaaactactaatatactaggaaatagaaatagcctagaacgagccgaaggacgacggctagtcctaactacgtcgtaggccgaaggaacgagtcggggtctacggtaggaatacgtaagg

SEQ ID NO: 367455 - DNA, 640 bp, Homo sapiens
  misc_feature: GZ8MTXP02GCZ7O.44.33.C11.1.454.CMB.2.raw
  modified_base (284)..(284): a, c, t, g, unknown or other
  modified_base (309)..(309): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagcctgggagtccctgagctctcctgtgtagcgtctggattcaccttcaaacngacatggcatgcacgtggggtcccnccaggcctcccgaagggccgaaaggggacctggggacggttggggtggcctaactttagtagttggggtatggaagttaggaaaagttaaattaaatatttaaagtaggttaagtaacgtttaccggtaggggtaaaacggggtacccgtatttacccaacctaacttcctacccgaaggacgtaaactaaacgttacgaaaacgaaacaactaactaataatacgtaggtaaaatagaaagttagacctaggacgacggacgaacggacgacgggctgtactacgtactgtcgacgagaagacggtggggccgtggaggtactacgtaag

SEQ ID NO: 367456 - DNA, 769 bp, Homo sapiens
  misc_feature: GZ8MTXP02H8T50.44.33.C11.1.454.CMB.2.raw
  modified_base (285)..(285): a, c, t, g, unknown or other
  modified_base (308)..(308): a, c, t, g, unknown or other
  modified_base (343)..(343): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtccctgagctctcctgtgtagcgtctggattcaccttcaaacngacatggcatgcacgtgggcccncaggcctccgaggccaaggggctggggagtggggngactattatagtgggtatgaagtaggtaaaagttaaattaaagttattaagtacggttaagtaacgtttccccgggtaagggtaaaacccgggggtacccgtaaacgtttacccaaacccgtaacttacccgttaaccccgtaaaggaaaccggtaaaaccttaaaacgtttaaacccgggaaaacgaaaaccctaaacccgtaaaccgtttaaattaaacgtttaccgtaaaagggtaaaacgtttaaggaaaacgtttaccggacccgttaagggaaacgggtacgggaacccccgggaaagggaaaccgtaacccggggtcgttaccgtaccgttaaaccgttaccgtagggttacggaaccggaaggtaacgggtacgggtacgggggtaccgttacgggtagggtaaaccttaacggaagg

SEQ ID NO: 367457 - DNA, 597 bp, Homo sapiens
  misc_feature: GZ8MTXP02HRXM1.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggacgtccctgagactctcctgtgtagcgtctggattcaccttcaacagacatggcatgcacgtgggtcccgccaggcctaccgaggccaaaggggctggggagtggggtgacctagttatagtggtatgaagttagggtaaagttaaattaattattaattaggttaacgtacgtttccggaggtaaacgggcccgtattccaacatctacccgaagtacgaactaaagttacgaaaacgaaaccaactaactaataacgttacgtaggaaaacttagaaatacgccgtagacggacgaccggaaggacacggtctgtactacgtactgagcgagaagacgtggctggtagatacgag

SEQ ID NO: 367458 - DNA, 637 bp, Homo sapiens
  misc_feature: GZ8MTXP02GL519.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggagtccctgacgactctcctgtgtagcgtctggacttcaccttcaacagacatcggcatgcacgtgggtcccgccgaggcctccgaggcgaagggactgggaggtgggtgctattatagtggtatgataggaaattaatatattatagtatacgttcggtagaacgggtcctattacccaacctactcctaccgaagacgtaactaaacgttcgaaagaaaccaactaacttaaatacgttacgtaagggaaattagaaaacttcggacctaggaacgacggacccggaaggaccgtaacgggtctttacggtacccgtttaaactcgttacggtacggtacggaaggtaagggtagggttcgggggtcgttacggtaagggtaactaaacggtaaagg

SEQ ID NO: 367459 - DNA, 609 bp, Homo sapiens
  misc_feature: GZ8MTXP02IYCRN.44.33.C11.1.454.CMB.2.raw
  modified_base (276)..(276): a, c, t, g, unknown or other
  modified_base (280)..(280): a, c, t, g, unknown or other
  modified_base (302)..(302): a, c, t, g, unknown or other
  modified_base (341)..(341): a, c, t, g, unknown or other
tcagacagtatatacacgaccggtgctcgatttagagtgagctcgttgggtttggggctggggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtccctgagctctcctgtgtagcgtctggattcaccttnaacngacatggcatgcactgggtccncaggctccgaggcaagggactggagtgggtgctacttanatggtactgataggaaagttaaataaagttattagtgttaagtactttacccgtggaaacggggtccgtaattaccaaccgtacttacctacccgaagaagtaacctaaacgttacgaaacgtaaacaactaacttaaataacttacgtaagggtaaattagtaaataacgacccgtaggacggacggaccggaggaaccgacggctacgtacttactacgtgtacgacgaagacggaggtcggggctcggtaggatacgagtaatag

SEQ ID NO: 367460 - DNA, 534 bp, Homo sapiens
  misc_feature: GZ8MTXP02HV20K.44.33.C11.1.454.CMB.2.raw
  modified_base (345)..(345): a, c, t, g, unknown or other
  modified_base (412)..(412): a, c, t, g, unknown or other
  modified_base (419)..(419): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagctctcctgtgtagcgtctggattccaccttcaacagacatggcatgcacgtcggggtccgccgaggcctaccgaggcgaaggggctgggaggtgggngcattatagtggtatgagtggaaagtaatatattatgtagtattcgtagaacgggcgtatcacatcncagacanaatacgaagaacacactatattactagaaatagaatacgactagagacgaccgagacgacggctgtactacgtactcgtagacgagaagtagtcggggctcggaggtactacgag

SEQ ID NO: 367461 - DNA, 687 bp, Homo sapiens
  misc_feature: GZ8MTXP02G6OJW.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagccgtgggacggtccctgacgactctcctgtgtagcgtctggattccaccttcaacagacatggacatgccacgtcgggtcccgccacggctccgaggcgaagggctgggaggtggggtgcctaattagtagtaggtatggaagtagggaaaacgtaaaagagtactaagtaggaaaaccgtcggtaaggaacgggccgtaattccgtccgtctaccgtagagactaactaccgaaacgaacctaccgtagtaactacgtaaacaaagttagaaactaagtttagaagtacgacggaaggtaccgtcgggtaccttacgtacctttaattacgtttacggtaaccgtaaccgtaccccgttaacgttacccgtttaccgttaaccggttaaccgggggacccgtaacgggggacccgtccccggttaccgggtacccctaaccccggtttccccg

SEQ ID NO: 367462 - DNA, 666 bp, Homo sapiens
  misc_feature: GZ8MTXP02G699W.44.33.C11.1.454.CMB.2.raw
  modified_base (248)..(248): a, c, t, g, unknown or other
  modified_base (283)..(283): a, c, t, g, unknown or other
  modified_base (287)..(287): a, c, t, g, unknown or other
  modified_base (363)..(363): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagccgtgggacgtcccngagactctcctgtgtagcgtctggattccaccttnaacngacatggcatgcacgtcgggtcccgccaggcctaccgaggacgaaggggctggggaggtgggtcgactaactttanagtagtatagataggaaattaaataattattatacgtagtacgtttccggaggtaacgggtccgtaattaccaacctagttacctaccgaaagtacgaaactaacgttaacggaaacaacctaaactaacttaattaacgttacgtaaaggtaaactagtaaagtacgtacccgtaggaacgacggaccgaagggaacccgtacggtaccgttacgtaccgttaaactaaccggttgtacggacggtaaggaacggtacgggttacgggggtaccgttacgggtacggtaagttaacgaaaag

SEQ ID NO: 367463 - DNA, 652 bp, Homo sapiens
  misc_feature: GZ8MTXP02F3G8T.44.33.C11.1.454.CMB.2.raw
  modified_base (282)..(282): a, c, t, g, unknown or other
  modified_base (286)..(286): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccaggcctgggaggtccctgagactctcctgtgtagcgtctggattcaccttnaacngacatggcatgcacgtgggtcccgccgaggcctccgaggcgaaaggggactgggaggtggggtggacctaacgtttaatagtgggtataggagtaggaaagttaaataagtattagtagttaagacgtttaccggagggaaacggggtacccgtatttacccaaccctacttccctacccgaaggaacgtaacctaaagttccggaaaacgtaaaccaaactaaaccttaattaactacgtaagggtaaaattagaaatacgtaccctaggaagacgacccggaaggaaccgacgggtctacgtactaccgttacgtggtacgcgaaagaaggacggtaggggccgtacggtaggaacgtacgaag

SEQ ID NO: 367464 - DNA, 524 bp, Homo sapiens
  misc_feature: GZ8MTXP02F0UJJ.44.33.C11.1.454.CMB.2.raw
  modified_base (309)..(309): a, c, t, g, unknown or other
  modified_base (350)..(350): a, c, t, g, unknown or other
  modified_base (375)..(375): a, c, t, g, unknown or other
  modified_base (382)..(382): a, c, t, g, unknown or other
  modified_base (388)..(388): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagcctgggagtccctgagactctcctgtgtagcgtctggattcaccttcaaacagacatggcatgcacgtgggtccnccaggctccaggcaagggactgggagtggggtgctacttanagtggtatgataggaaattaatatntatgtanattcgngaaggcgtatcacatctcagagacaattacgaaagaacaacaactaatatactaggaaatagaaatagacctgaagacgacgaggacacggctagtactactactgtgcgagaagagtcggggctggtggatgacg

SEQ ID NO: 367465 - DNA, 511 bp, Homo sapiens
  misc_feature: GZ8MTXP02JSVGY.44.33.C11.1.454.CMB.2.raw
  modified_base (342)..(342): a, c, t, g, unknown or other
  modified_base (400)..(400): a, c, t, g, unknown or other
  modified_base (418)..(418): a, c, t, g, unknown or other
  modified_base (507)..(507): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcaccttcaacagacatggcatgcactgggtccgccaggcctccgaggcaaagggctggagtgggtgctacttanatggtatgatggaaataataaatattatgtagattccgtagaacgggcattcacatcncagagacaattacgaaanaacacatatatctagaaatgaatagctagagagcgaagacacgctacggtactactactgacgacgagtagagtggcgcgtgagtacanatag

SEQ ID NO: 367466 - DNA, 748 bp, Homo sapiens
  misc_feature: GZ8MTXP02FS9BL.44.33.C11.1.454.CMB.2.raw
  modified_base (191)..(191): a, c, t, g, unknown or other
  modified_base (228)..(228): a, c, t, g, unknown or other
  modified_base (258)..(258): a, c, t, g, unknown or other
  modified_base (289)..(289): a, c, t, g, unknown or other
tcagacagtatatacacgaccggtgctcgatttagagtgagctcgttgggtttggggagagaagacaggactcaggacgatctccagcatggccggcttccctctcctcctcaccctcctcactcactgtgcagggtcctgggcccagtctgtgctgactcagccatcctcagcgtcgtgggacccccggnagacggtcacgatcttttgtctggaagtaggtccaanatcggaataattacgtatactggtatcggnaattcacaggacgcggtccccagaccccctnatctataggagaatcagccgcctcgacggggtccctgaccgtattcctctcgccctcaagtctcggccaccctcgacgtccctcccgtgggccctaatccgtaaggtcggggtccctttcccggggacccgagggaagttcggaacggggtccttagggtaaattttacgtttttccgtggttcggtacgggttcgttagggggtaatacgggtacctacgtttcccgtaggtaacggttcggggtaaacttcggacgtttaacggtttcccgggggtaacggggtaacgggggaacccgtaaaacgggtcccgttacgggtaaacccccggttacgttaaaccggtaccgtaaaccggtaccccgaaaacgggtcccgtacccggtcccccccgttccgggttaccctaacccggtttccctttacccggtttaacccccctacccccttttaccccg

SEQ ID NO: 367467 - DNA, 711 bp, Homo sapiens
  misc_feature: GZ8MTXP02I58H4.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctctgtgtagcgtctggattccaccttcaaacagacatggcatgcacgtcggccgccaggcctccgaggcgaagggactggaggtgggtggctacgttatagtaggtatggtaagtagggtaaaagttaaattaaattatttaagtacgttaagtaacgtttacccgggaagggtaaacggggtaccctaagtttacccaacccgtaataccctacccgaaaggacgtaaactaaacgttaaccgaaaacgaaacctaaacaaacttaaataacgttacgtaaggtaaaattaaggaaattaacggaccgtaaggaaacggtacggaacccggaaacggggaaccaaccgggggtccttacgggtacccttaaacgttaacgttcgggtacggaccgggtaaggaacggtagggttacgggggtcccttacgggtaggggtaaaaccttaacggtaaagg

SEQ ID NO: 367468 - DNA, 600 bp, Homo sapiens
  misc_feature: GZ8MTXP02JLVIR.44.33.C11.1.454.CMB.2.raw
  modified_base (576)..(576): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcaccttcaacagacatggcatgcctacgtcgggtccgccaggctccgaggcgaaacggggctgggaggttgggtggctacgttatacgtgggtatgtaagtggtaaaagttaaataattagttaaattgggttaaagatttacccgggaggtaaacggggcccgtaatttaccacctattcctacccgaagacgaactaaacgttacgaaagtaaacaacacttaatactactaggaaactagaactagctagacgaagccgaagacacgggtctacgtactaccgtactgtacgcgagaagngtcggggctcggtaggatacgaag

SEQ ID NO: 367469 - DNA, 688 bp, Homo sapiens
  misc_feature: GZ8MTXP02GGC84.44.33.C11.1.454.CMB.2.raw
  modified_base (308)..(308): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacggtccctgagactctcctgtgtagcgtctggattcaccttcaacagacatggcatgcacgtgggccnccgaggctccgaggcaagggacgtgggaggtgggtggctacgttatagtgggtatgagtaggaaagttaataatattatagtagtacttaccgaggtaacgggccgtattaccaaccgtattacctacccgaagaacgtaactaaagtttaccgaaaacggtaaaccaaactaaaccttaaagttaactaccgttaaagggtaaaacttagaaaacgttacggacccttaggggaaacgtacgggacccggaaaggggaacccgaaccgggtaccgttagggttaaccccttaaacgttccgttaggtacggaccggtaaaggaacgggtaaggttcgggggtaccgttacgggtacggggtaaactttaaccggaaagg

SEQ ID NO: 367470 - DNA, 522 bp, Homo sapiens
  misc_feature: GZ8MTXP02HVHY5.44.33.C11.1.454.CMB.2.raw
  modified_base (304)..(304): a, c, t, g, unknown or other
  modified_base (343)..(343): a, c, t, g, unknown or other
  modified_base (369)..(369): a, c, t, g, unknown or other
  modified_base (377)..(377): a, c, t, g, unknown or other
  modified_base (400)..(400): a, c, t, g, unknown or other
  modified_base (405)..(405): a, c, t, g, unknown or other
  modified_base (416)..(416): a, c, t, g, unknown or other
  modified_base (480)..(480): a, c, t, g, unknown or other
  modified_base (520)..(520): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggaggtccctgagactctcctgtgtagcgtctggattcaccttcaacagacatggcatgcactggggtccnccagggctccgaggcaagggctggagtgggtgcacttanagtggtatgatggaaattaataaatntatgtaanttccgagaagggccatcacatcncaganacaatcgaaanaacacactatatcgaggaaatgaatacgcgtagggacgccgaaggacgacggctgtctactacngtgacgagacgtagtggggctcggtaggatacgagtatanag

SEQ ID NO: 367471 - DNA, 578 bp, Homo sapiens
  misc_feature: GZ8MTXP02GE7WB.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggacggtccctgagacctctcctgtgtagcgtcgtggacttcaccttcaaacagacatggcatgcacgtcgggtccgccaggcctccgaggcgaaaggggctggggacggtggggtgcacttagaatgggtatgatggaaaattaatatattatagtagtattcgaggaggcgtattcacatcctacaagagtaacaaattacgaaacgtaaacaactaactattacgtactaagggtaaatacgaaaattacgccgtaggaacgacggacccgaaggacacggctagtcctaaatcgttgacgacgagaagaggtcgggtactggtaggatacgaaag

SEQ ID NO: 367472 - DNA, 671 bp, Homo sapiens
  misc_feature: GZ8MTXP02G3PXA.44.33.C11.1.454.CMB.2.raw
  modified_base (287)..(287): a, c, t, g, unknown or other
  modified_base (376)..(376): a, c, t, g, unknown or other
  modified_base (416)..(416): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagcgtggtggagtcgtgggggaggcgtggtccagccgtgggacgtccctgagctctcctgtgtagcgtctggattcaccttcaaanagacagtggcagtgccacggttcgggtcccgacccagggccctaccgagggcaaaggggacctggggaggtggggtcgactacgtttanacgttgggtatggaagttaggggaaaattaaacttaattntttaactaggttaacgtacgtttcccgggaggtaaacggggtcccgtaattccaaccaagttcctaacccgaagaacgaactaaacgttacgaaaacgtaaaccaactacttaaatagttacgtaaggtaaaatagaaattacgaccgtaggaacgacggaccggaggaaccgaccggtcgttacgtaccttacgtacgttcgtacggacgaagaaggacggttcgggggacttacggtacggtaagtacgaaag

SEQ ID NO: 367473 - DNA, 752 bp, Homo sapiens
  misc_feature: GZ8MTXP02H6H25.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggaggtccctgagactctctgtgtagcgtctggattcacttcaacagacatggcatgccacgtggggtcccgccaggcctaccgaggcgaaaggggctggggaggtggggtaggctaacgtttagtagtgggttaatggaattaggggaaaagttaaattaaagttattttaaagtaggttaagtaacgtttcccggaaggtaaacggggaccccgtaagttaccaaaccctatacctacccgaaaggaacgtaaaccgtaaacgttaccgaaaagaaaacccaaactaaacctttaaataaacttaccgtaaagggtaaaaacttagggtaaaacttaacggacccgtttaaggggaaacggtaaccgggaccgggaaacggggaaacccgtaacgggggtaccttacgggttacccttaaaacggtccgtttaagggtcgggaaccgtaacggggaaggtaaacgggtcggggggtacccgttagggtaaggggaaacctttaacggaaagg

SEQ ID NO: 367474 - DNA, 699 bp, Homo sapiens
  misc_feature: GZ8MTXP02JCHVW.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggagtccaatatcggatcttatcctgtcaactggtatcggggactcccgaggccaccggccccccgtagtccttactctactcgctactaactctacgacggccctcctacgggtcccgtccgtccgtacgttcctccgtcggtctccgtaacgtccgttcgccgtactaacgacggacctaccgtacggtccgacttcccgttcgtatcctccgtacgttccgtgacgggtagtggtaacggtcgtaggtactttaccttaacgttcgttagtccgacgaccgtagtggggtacgtacggtaacgacgggtaccgggaaacggggtcggtgggggtttcgggtttaccggggccgggggaaacgggtacccggtaaacggttacgggtaccccggttaccggttaacgggttacccgaacggtaccccggaaacggtcccgtaccggtccccccgttacccggg

SEQ ID NO: 367475 - DNA, 524 bp, Homo sapiens
  misc_feature: GZ8MTXP02I7A1N.44.33.C11.1.454.CMB.2.raw
  modified_base (285)..(285): a, c, t, g, unknown or other
  modified_base (307)..(307): a, c, t, g, unknown or other
  modified_base (338)..(338): a, c, t, g, unknown or other
  modified_base (345)..(345): a, c, t, g, unknown or other
  modified_base (369)..(369): a, c, t, g, unknown or other
  modified_base (425)..(425): a, c, t, g, unknown or other
  modified_base (430)..(430): a, c, t, g, unknown or other
  modified_base (459)..(459): a, c, t, g, unknown or other
  modified_base (516)..(516): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctcctgtgtagcgtctggattcaccttcaaacngacatggcatgcacgtgggccnccaggcctccgaggcaagggctggagtgggngcattanagtggtatgatggaaagtaatatnttatgtagtagttcgagaacggccagttccacatcaccagacgacaagtacgaaanaacanactatatctaggaatagaaatagctaganacgacgagacacggctagtcctaactacgtgtacgcgagaagtagtcggggctcggngatacgag

SEQ ID NO: 367476 - DNA, 730 bp, Homo sapiens
  misc_feature: GZ8MTXP02HBKFZ.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggaggtcctgagactctctgtgtagcgtctggattccaccttcaaacagacagtggcatcgacacgtgggtcccgaccaggcctacccgaggacgaacgggtacgtggggtagtggggtcggactaacgtttagtacgttaggtaatggaagttaaggtaaaagttaaaagttaaattagtttaagtagttaaagttacgtttacccggtaaggaaaccggggtcctaaacgtttaccaaaccctaacgttccctaacccgaaagaacgtaaacctaaaagttaccgaaaaacgaaaccaaactaaaccttaaattaacttacgaaagtaaaactagaaagtaacgtacccgtagaaagggaaccgaccgggaaacggtaaccgaaccggtccgttaaggttaaccctaaacggttaaccgtcggacggaaccggtaaaggaaccggtaggttacgggggtccttacggggtaggtaaacccttaacgaaagg

SEQ ID NO: 367477 - DNA, 605 bp, Homo sapiens
  misc_feature: GZ8MTXP02F05LS.44.33.C11.1.454.CMB.2.raw
  modified_base (177)..(177): a, c, t, g, unknown or other
  modified_base (302)..(302): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagnggtgtccagtgtcaggtgaagctggtggagtcgtgggggaggcgtggtccagcctgggagtccctgagactctcctgtgtagcgtctggattcaccttcaacagacatggcatgcacgtgggccncaggctccgaggccaaggggctgggagtgggtggctacttatatggtatgataggaaagttaataaattattagtgtaagtactttccgaggaaaggggtccctaattaccgaacctaattcctaccgaagaacgaacctaaattacgaaaagtaacaaacaacttaataactacgtaaggtaaatagtaaattagacccttaggaacgacggaccggaggaccgacggtctacggtacctaactaccgtaggtacgacgaaggagtaggtggggtcctacggtacggataacgagacttaag

SEQ ID NO: 367478 - DNA, 737 bp, Homo sapiens
  misc_feature: GZ8MTXP02JXZ8Q.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcacgccaccctcagccgtcgtcggggacccccgggcgacgggggtcaccatctcttgttctggaaggagtccaatatcggatcttatcctgtcaactggtagtcgggactcccgaggccacccggcccccgactccttatctatgctactaatcacgccgccctcgacggggtccctcggccccgtattccctcgtcggcctaccaagtcgtggccaccgtacacggcctaccgtcgggccctacttcccgttagtaacttcccgtaccgtacgttcgtaggagggtagtacgggtacgggtccgttaggttaaactttaaccgtttaacgttggttcgaccgtaggtaccgaacggttagggggacttacgggaaccggaacggggtaccccgggaaaacgggggtccggtttcgggggttcgggtttaccgggggaccggggtaaaccgggggtaacccgttaaacggggttccgggtaacccggttcccgggtaacgggggtacccgaccgggtacccggaaccggtcccggtaccccggtcccccggtttacccggg

SEQ ID NO: 367479 - DNA, 661 bp, Homo sapiens
  misc_feature: GZ8MTXP02HVUEV.44.33.C11.1.454.CMB.2.raw
  modified_base (315)..(315): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatccggagtttgggctgacctgggttttcctcgttgctcttttaagaggtgtccagtgtcaggtgaagctggtggagtcgtgggggagcgtggtccagccgtgggaggtccctgagactctctgtgtagcgtctggacttcaccttcaaacagacatggcatgaccacgtggggtcccnccaggcctaccgaggcaaaaggggctggggagtggggtgaccaatttatagtggtaatggaattggggaaaattaaaataaattagttaaagtgtaagtaactttcccggaggaaacggggtccctaaatttcccaacccaattccctacccgaaaggtaaacgtaaactaaacgtaacgaaacgaaaccaactaaacgttaaatacgtacgtaaaggtaaataagtaaagtaacgtacgtacggaacggaacggaccggaacggaacgacggtacgtacgtactacgtacgtacgtacgacgaggaagtaggtacgggtacggtacggtacggtaacgtaacgag

SEQ ID NO: 367480 - DNA, 706 bp, Homo sapiens
  misc_feature: GZ8MTXP02FLXXK.44.33.C11.1.454.CMB.2.raw
  modified_base (209)..(209): a, c, t, g, unknown or other
  modified_base (244)..(244): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccactctgtgctgacgcagccgccctcagtgtcgtcgggggccccgggnaggacgggtcaccatcctcctgcacgtggggaacncagactaccaagagtcggacagtacttcgtagatcgtcctacgtacgtaaccaactacctacgaacgaaccaccgacccctaaactcctactacttacgtttacgtaaacctaacgttacgtccggtaccctacggtaccggggttccccctacgaccgtacttccgtcgtcggtaccttaccgtaacggtccgtacggacctacccgtacgaccgtccccgttcccgtcgtaccctactccgtacggtccggggtaccctaccgtacggtacgtaaggaaacgtagtagggtaagggttacttaagtttacttacgtacgacctacgttactagtacgacgacgactacggtaccgtacgtagggtttggggtttacggggttcgggttacggggacggggaacgggaccgaacggtccgtacggtacccggtccggtcggtaccgaccggacccgtacgg

SEQ ID NO: 367481 - DNA, 578 bp, Homo sapiens
  misc_feature: GZ8MTXP02FTA7Q.44.33.C11.1.454.CMB.2.raw
  modified_base (187)..(187): a, c, t, g, unknown or other
  modified_base (208)..(208): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctnagcgtctcgggacccccgggnagggggtcaccatctcttgttctggaagagtccaatatcggatcttatcctgtcaactggtatcggggactcccgaggcacccggcccccgactcctatctatgctactaatcagccgccctcgacgggtccctgcccgtattccctctcgctccaagtctggcactacaggctacatcgccactcctgtactctcctagtctgagatgagctagtattactactgtgacagcagtgggataggacgacggaccgggtaacggcggttaggggtcggttcggggacggggtaacgggaacccgtaaggttccggaaccgtaaccgtacggtccgaaaccggcccgtaaacggcccgtaccgtccccccgg

SEQ ID NO: 367482 - DNA, 589 bp, Homo sapiens
  misc_feature: GZ8MTXP02HI55L.44.33.C11.1.454.CMB.2.raw
  modified_base (311)..(311): a, c, t, g, unknown or other
  modified_base (385)..(385): a, c, t, g, unknown or other
  modified_base (418)..(418): a, c, t, g, unknown or other
  modified_base (442)..(442): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggacggtccctgagactctcctgtgtagcgtctggattcaccttcaacagacatggcatgcacgtcgggtccnccaggcctaccgaggcgaagggctgggagtgggtgctacttatagtggtatagataggaagttaaatatactangcagactcgtaggaacggcatcacatcacaganacaataccaagaacagctgtactnacgacaaatacgaacacgtaccgtagaacgacggaccgaacggaccgtaacgggtcttacgggttcgttaaacgtttaccggtaggttacgaaccggtaacggaaactagttaacgtttacgggtaaacgtttaacccttaaccccg

SEQ ID NO: 367483 - DNA, 682 bp, Homo sapiens
  misc_feature: GZ8MTXP02HCJLO.44.33.C11.1.454.CMB.2.raw
  modified_base (268)..(268): a, c, t, g, unknown or other
  modified_base (286)..(286): a, c, t, g, unknown or other
  modified_base (313)..(313): a, c, t, g, unknown or other
  modified_base (359)..(359): a, c, t, g, unknown or other
  modified_base (372)..(372): a, c, t, g, unknown or other
  modified_base (407)..(407): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggacgtcctgagctctcctgtgtagcgtnggattccaccttcaaacngacagtggctatcgcacgtcgggtccnccgaggtccctccgaaggccgaaaggggacctggggaggttcgggngactaacgtttanacgtgggtatcggaatagggaaaattaaataaatnttagtacgtaagtacgtttccggaagggtaaccgggtaccgtaatttaccaacctactacctacccgaaagacgaaacctaaattacccgggaaaacaaacctaaactaacttaaataacttagaaaggtaaatacgaaacgtacgaccgtaaggaacggaccggaaccgggtaggaaccgtacggtcgtttacgtaaccttaacgtaacgttcggacgtacggaaaggtaacggtagggtcggggtacgtaacggttagaaacgtaacgtacgg

SEQ ID NO: 367484 - DNA, 641 bp, Homo sapiens
  misc_feature: GZ8MTXP02G1OT6.44.33.C11.1.454.CMB.2.raw
  modified_base (354)..(354): a, c, t, g, unknown or other
  modified_base (381)..(381): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggacggtccctgagactctcctgtgtagcgtctggattcaccttcaacagacatggcatgcacgtcgggtccgccaggcctccgaggacaaggggctgggagtggggtgcacttanagtggtatgagtggaaagttaataatnttaatgtagtagttccgaggaaacgggtccctagttaccaacccattaccgtacccgaagaacggaactaaacgttacggaaaacgaaaccaaactaaccttaaataacttacgtaaagggtaaaacttaggaaacttaacggaccgtaggaacggaacggaccggaagggaacccgaacgggtccttaggtaccttacgttaacgtgggtacgacggaaggaacggtaggtcgggggtctaggtaggaacgtacgaagg

SEQ ID NO: 367485 - DNA, 556 bp, Homo sapiens
  misc_feature: GZ8MTXP02GI8XW.44.33.C11.1.454.CMB.2.raw
  modified_base (491)..(491): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggaggaggcttagtccagccgtggggggtcccagagactctcctgtgcagcctctgggctcaccgtcagcagcaactacatgagttgggtccgccaggcctccgaggggaaggggctgggagtggggtctcgagtctatttactactggtgatttcactatactacgcagactccgtagaagggccattcacccatcctccgagggacaacttccaggaactacgttatcttacaaatgaaacacctgagaggcgacgacgacggccgtatattacngtcgcgacgacgaacgtcgcgctcggaagttggttaattacgttcgtttagactttcgtcggggg

SEQ ID NO: 367486 - DNA, 532 bp, Homo sapiens
  misc_feature: GZ8MTXP02F3A6B.44.33.C11.1.454.CMB.2.raw
  modified_base (300)..(300): a, c, t, g, unknown or other
  modified_base (337)..(337): a, c, t, g, unknown or other
  modified_base (367)..(367): a, c, t, g, unknown or other
  modified_base (372)..(372): a, c, t, g, unknown or other
  modified_base (418)..(418): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggattcacttcaacagacatggcatgcactgggtccnccaggctccaggcaagggctggagtgggtgcacttanatggtatgataggaaataataaagtattangtaanattccgtgaaacgggtccattacacatctacagagacatacgaaanacacactatatacgtagaatagaagtacgacgtagacgacgacgagacgacgtctacgtactactacgtagacgacgagagtaggtcgggtctacggtagaagtacgacgatag

SEQ ID NO: 367487 - DNA, 608 bp, Homo sapiens
  misc_feature: GZ8MTXP02HOJ43.44.33.C11.1.454.CMB.2.raw
  modified_base (349)..(349): a, c, t, g, unknown or other
  modified_base (590)..(590): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggagtcctgagctctcctgtgtagcgtctggacttcaccttcaacagacagtggcatgcacgtcggggtcccgccaggcctaccgaggacgaaagggctggggagtggggngactacgttatagtggtaatggaataggtaaaagttaaattaatatttaagtagtaagtacgttaccggtaggaaacggggcctaattaccacctactaccgtaccaaggaacaaactaaattaacgaaaacgaaacaactaacttaaagtaacttagaagggtaaaatgtaaaagtacgcctaaggaacgacgacggaacggtacacggcttgtactactacgtgacgacgagaagaggngggctaggagataacgag

SEQ ID NO: 367488 - DNA, 592 bp, Homo sapiens
  misc_feature: GZ8MTXP02GGXJA.44.33.C11.1.454.CMB.2.raw
  modified_base (308)..(308): a, c, t, g, unknown or other
  modified_base (356)..(356): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctggaggaggcttagtccagccgtggggggtcccagagactctcctgtgcagccctctgggctcaccgtcagcagcaactacatgagttgggtccncaggctccgaggggaaggggctgggagtggggtctcgagtctatttanacgtggtgtaatttcactatactacgctaagacctcccgtagaaacggggtccaattcaacctatcctacccgaagggacaacgttcccaagggaacctacggtttataccttaacaaatacgaaacaacctgaagaacggcgaacgacacgggtcctactattacctgtcgaccgagaaccgaaggtcgcgcgtcggaagttggttaacttagttcgtttagacttcgtacgggg

SEQ ID NO: 367489 - DNA, 707 bp, Homo sapiens
  misc_feature: GZ8MTXP02I4ZNR.44.33.C11.1.454.CMB.2.raw
  modified_base (211)..(211): a, c, t, g, unknown or other
  modified_base (261)..(261): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcggggacccccgggngacgggggtccaccatctcttgtctggaagagtccaatatcggatcttancctgtacaacgtggtacgtccggggactcccgaggcccgaccggccccccgtaacttcccgttaatcctaagtcgacctaactaatcgacgtcccgaccccgtgaccggggtcccctcggaccccgtatttccccgtcgtaccggtcctaccgtaagtccgttagggcctaaccgtaacgaacggtccctaaccgtcggtaccctacgttcccgttagtacttccgtacccgtagttccgtagaggtacgtaggaggtctagttaacgttactagttgtacgactaggctaagtggggaacttcgggaaccgtacgggacccggggtaacggtcggttagggggtaccggtttcgggggacggttaaaccggggacgtacgggttacggacccgttacggaaggtacccgacgacccggtacggcccgtcccgacccccgttccgg

SEQ ID NO: 367490 - DNA, 677 bp, Homo sapiens
  misc_feature: GZ8MTXP02GQMMU.44.33.C11.1.454.CMB.2.raw
  modified_base (269)..(269): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccggcagggggtcaccatctcttgttctggaagaagtccaatatcggatctatcctgtcaactgtancgggactcccgaggccacccggcccccactccttatctatgctactaatcgagcccgccctcgacggggtcccctcgcccgtattccccgtctcggtcctccgaagtcctgggccactacgacggtcctaccgtggaccctacttcccgttagactccgtaccgtacgttccgttagacggagttcggaggtccttaggtaactttaacctacgttcggtagaccgaagttccaaggttagggtatacggaaccgacgggaacccggggtaacgggtccggtagggggtttcggttaccggggaccgggggtaacgggaaacccgtacgggttaccggaacccggtttaccgtaagggttacccgaacggacccggtaacggcccgttacccggcccccggtttccgg

SEQ ID NO: 367491 - DNA, 516 bp, Homo sapiens
  misc_feature: GZ8MTXP02HTJJS.44.33.C11.1.454.CMB.2.raw
  modified_base (308)..(308): a, c, t, g, unknown or other
  modified_base (341)..(341): a, c, t, g, unknown or other
  modified_base (373)..(373): a, c, t, g, unknown or other
  modified_base (409)..(409): a, c, t, g, unknown or other
  modified_base (420)..(420): a, c, t, g, unknown or other
  modified_base (476)..(476): a, c, t, g, unknown or other
  modified_base (493)..(493): a, c, t, g, unknown or other
tcagacagtatatacacgaccggtgctcgatttagagtgagctcgttgggtttggggagctctgggagagaagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagccgtgggaggtccctgagactctcctgtgtagcgtctggattcaccttcaacagacatggcatgcactggggtccncaggcctccgaggcaaaggggctgggagtgggngccattatatggtatgatggaaagttataatnttatgtagtatcgtagaggcgatcacatctccaganacaattcgaanaacacatatatctagaatagaatagactgagagcgagacgacgctgtactactacngtcgacgagaaggtagngggggtctcggtagactacgaag

SEQ ID NO: 367492 - DNA, 759 bp, Homo sapiens
  misc_feature: GZ8MTXP02JQO5O.44.33.C11.1.454.CMB.2.raw
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcacgccaccctcagccgtcgtcggggaccccccgggcggacggggtaccaccgtactcttcgttcgttcgtagggaaacggtacgtacctaatacgtacgtacttacttactcctagtactacgtggtacggtccggtaccctccggacggcccgaccccggtccccccgtacttccgttactctagtcgactactagtcgacggccgtccgtacggaccggtcccgacgtcctacgttcctcgtcgtacctacgtacgtcgccgacctacgtacgtacgtccgtacgtcgtacctacgttcgtacgtactcccgttacgtacgttacggtagacgtagtacggggtaacggttctacgttaacgtttaccgtaggttacggtacgaccgtaaggtccggttaaaggtcggtacgtaccgacggaccggggtaccgggaaccggttcggggtgggttacggggtacgggaccggggaacgggttaacctacgggtaccggtaccgttacggtacggtacccgaccgttaccgggaaccgtcccggtcccggtccccgttactacccgtccggttccctaccccgttcccaccgtttacc

SEQ ID NO: 367493 - DNA, 552 bp, Homo sapiens
  misc_feature: GZ8MTXP02JFU97.44.33.C11.1.454.CMB.2.raw
  modified_base (288)..(288): a, c, t, g, unknown or other
  modified_base (346)..(346): a, c, t, g, unknown or other
  modified_base (355)..(355): a, c, t, g, unknown or other
  modified_base (362)..(362): a, c, t, g, unknown or other
  modified_base (388)..(388): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccatccgtgggacggtccctgagactctctgtgtagcgtctggattcaccttcaaacngacatggcatgaccacgtgggtcccgccaggcctccgaggcgaaggcgtggagtgggngcctattanatggtangagtagaaattaatatattatagtanattcgagacggctatcgacatcctacagacgactaatacgaaagaacaacaactatatactaggaaatagaaatagaccgtagagacggacgaagacgtacggctacgtactacttaacgtcgtagacgtagaaggagtcggggactaggtacgtaatacgaag

SEQ ID NO: 367494 - DNA, 835 bp, Homo sapiens
  misc_feature: GZ8MTXP02GLR0U.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggagtcctgagctctcctgtgtagcgtctggattcaccttcaacagacatggcatgcacgtgggtcccgccaggcctaccgagggcgaaaggggcctggggaggttggggtaggcctaacgtttagtacgtgggtaatggaagttagggtaaaagttaaattaaattatttaaataggttaacgtacgtttaccggtagggtaaacggggtacccgtaatttacccaacccgtaattacccgttaacccgaaacggtaacgtaaaccgtaaaacgtttaacccgggaaaaaacgaaaacccgtaaaacccgtaaaccgtttaaaatttaaacgtttaacccggttaaaaggggttaaaaaacgtttaggaaaaaaccgtttaacgggacccccgtttaaaggggaaacgggtaaaccggggaacccccggggtaaaacgggggaaaccccgtaaaccgggggttaccccgtttaacggttacccgttaaaaccggtttaaccccgtttaggggttacgggaacccgggtaaaggaacgggtaacggggttcgggggtaccgttaccggggtaggggttaaaccttaacggtaaacggg

SEQ ID NO: 367495 - DNA, 654 bp, Homo sapiens
  misc_feature: GZ8MTXP02JUG2M.44.33.C11.1.454.CMB.2.raw
  modified_base (383)..(383): a, c, t, g, unknown or other
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcagccaccctcagcgtcgtcggggaccccccgggcgaggggtcaccatctcttgttctggaaggagtccaatatcggatcttatcctgtcaactggtatcggggactcccaggccaccggccccccgactccttatctatgctactaatcacgcgccctcgacggggtccctcgcccgattctcgtcggctccgaacgtctcggctacctcacgtccctccgnggcccatcacgtcgggcctccgagccgtagaacgagtggagggtgtaattacgttactcgcctagttaccctatacgacgagcctagacctcgtaggttcgggttggggttcggttacggggcggggtaacgggtaccgaaacgggtccgtccggtaacccggttccggtacggggtccgaaccggtaccccggaacggtccgtcccgggtcccccgtcggggtaccctccgttcccgttcccggtttacccccgaaccccgtttcccccg

SEQ ID NO: 367496 - DNA, 528 bp, Homo sapiens
  misc_feature: GZ8MTXP02IISMY.44.33.C11.1.454.CMB.2.raw
  modified_base (302)..(302): a, c, t, g, unknown or other
  modified_base (339)..(339): a, c, t, g, unknown or other
  modified_base (370)..(370): a, c, t, g, unknown or other
  modified_base (497)..(497): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctgggtggagtctgggggaggcgtggtccagcctgggagtccctgagactctcctgtgtagcgtctggattcaccttcaacagacatggcatgcactgggtccncaggctccaggcaagggactggagtgggtgcacttanatggtatgatggaataataaatattatgtanattccgtagaagggccagttcacatctcagagacaattcgaaagaacaacactataatctaggaaatagaatagccgtagggagccggaaggacacggctagtctactactgtagacgagagtaagnggggaactcggtaggactacgagatagtacg

SEQ ID NO: 367497 - DNA, 625 bp, Homo sapiens
  misc_feature: GZ8MTXP02I9HUX.44.33.C11.1.454.CMB.2.raw
  modified_base (285)..(285): a, c, t, g, unknown or other
  modified_base (312)..(312): a, c, t, g, unknown or other
  modified_base (489)..(489): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacgtccctgagacctctcgtgtgtagcgtctggacttcacccttcaaacngacagtggcagtcgcacgtcgggtccncagggcctccgaggacgaaggggctggggacggtggggtcgactaacgtttagtagtcggggtatggtagtacgggaaaagttaattaaaattagttacgtgggtaacgtagtttcccgggagtaaacggggccctattaccaccgtatcctaaccgagaacgaactatacggaaanaacactaatataatcgtaaggtaaatgaaatacgacctagaacgacgacggagacgtacggtctacgttacgttactaacggtgtacggacgaagtcggtaaggcggggtctcggtaaggtaactacgagtataag

SEQ ID NO: 367498 - DNA, 548 bp, Homo sapiens
  misc_feature: GZ8MTXP02GA8DF.44.33.C11.1.454.CMB.2.raw
  modified_base (310)..(310): a, c, t, g, unknown or other
  modified_base (381)..(381): a, c, t, g, unknown or other
  modified_base (385)..(385): a, c, t, g, unknown or other
  modified_base (389)..(389): a, c, t, g, unknown or other
  modified_base (394)..(394): a, c, t, g, unknown or other
  modified_base (412)..(412): a, c, t, g, unknown or other
  modified_base (430)..(430): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagacatggacatgcacgtcgggtccnccaggcctccgaggccaaaggggctgggaggtggggtgcacgttatagtggtatgatggaaagtaataatnttangtanttcgngacggcatcacatctcanagacaatcgaaagaacanaactatactactaggaaatagaaactagacctagagagaccgaggacgacgggcttaggtacctaacgtactacgtgacgaagaaggtagtcgggggctacggtaggaactacgtaag

SEQ ID NO: 367499 - DNA, 660 bp, Homo sapiens
  misc_feature: GZ8MTXP02GCZ9Z.44.33.C11.1.454.CMB.2.raw
  modified_base (284)..(284): a, c, t, g, unknown or other
  modified_base (638)..(638): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggaggaggcttagtccgaggccgtggggggtcccaggagactctcctgtgcacgcctcgtgggctcnccgtcagcacgcaactacagtgaggttcggccgccgacggcgtaccggaggggaacggggcgtagggaggtcggggtctacgaggtctatttactacgtggtagtactttcactataccgtacgcaacgtacctccggtaggaacgggcctacttccaccctatccgtaccgaagggtacctaaacgtttccgaaacggtaacttacggtttataccttaagaaatacgaaacaccgtagggaacgacggaccgacgaacgaccggtccttactaacgttaccgtaggtcgacggaacgaacgtacggtccggacgtcggttacggaagtttggttactttacgttccggtttntaaccggttcgggtaaccgggg

SEQ ID NO: 367500 - DNA, 793 bp, Homo sapiens
  misc_feature: GZ8MTXP02IVMG7.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtcctgagctctcctgtgtagcgtctggattcaccttcaacagacatggcatgccacgtcgggtcccgccgaggcctacccgagggaccaaaggggtaccgttaggggaggttcggggtacggtcctaaacgttttaagtaacgttaggggttaacgttaggtaaagttaggggtaaaaagtttaaaagttaaagtttaactttaaaggttacggttaaagttaccgtttaccgggttaagggaaacgggggtacccgtaacgtttaccgtaaccctaacgttacccgttacccgaaggtaaacggtaaactaaaacgtttacggaaaacgaaacctaaaccctaaaactttaacgttaaactttacgttaaagggtaaaacgttaagtaaaacgtttaacggaccggttaggaaaacggtacgggaaccggtaacgggaaaccgtaaccgggggtactttacggttaccttaaaaccgttcgttacggtacggtaccggaagggtaaggacgggttcgggggtaccgtcggttaaggtaacgtaacggtaaag

SEQ ID NO: 367501 - DNA, 591 bp, Homo sapiens
  misc_feature: GZ8MTXP02FHBOR.44.33.C11.1.454.CMB.2.raw
  modified_base (279)..(279): a, c, t, g, unknown or other
  modified_base (306)..(306): a, c, t, g, unknown or other
  modified_base (353)..(353): a, c, t, g, unknown or other
  modified_base (546)..(546): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggagcgtggtccagccgtgggagtccctgagactctcctgtgtagcgtctggattcaccttnaacagacatggcatgcacgtgggtccnccaggcctccgaggcaaggggactggggagtggggtcgctaacttanagtggtaatggagttaggaaagttaataactattagtgtagaattccggtaggaacgggccgagttccaaccgtactccgtaccagacgaactaagttacgaaacgaactacactaatactacgtaggtaaaattgaaatagccctagacggaacgaccggtacgaccacgggtcctagtacctacgttacgnggtcgacgtaggaagtgttcggggcttaggtcggaactacgaagg

SEQ ID NO: 367502 - DNA, 643 bp, Homo sapiens
  misc_feature: GZ8MTXP02FOM2P.44.33.C11.1.454.CMB.2.raw
  modified_base (317)..(317): a, c, t, g, unknown or other
  modified_base (368)..(368): a, c, t, g, unknown or other
  modified_base (405)..(405): a, c, t, g, unknown or other
tcagacagtatatacacgaccggtgctcgatttagagtgagctcggttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccaggccgtgggaggtccctgacgactctcctgtgtagcgtctggattccaccttcaaacagacagtggcagtcgcacgtgggcccncgaggctaccgaggccgaaggggactgggaggtggggtcgctaacgtttanagttgggtatggtaatagggaaaattaaattaagttnttaagtgtaacgtactttaccgggagggaaaccgggtccgtaattaccaacccacttccaacccaggaacgaacgtaaacttaccggaaaagtaaccaaactacttaaatatacgtaaggtaaaatagtaaagtacgaccgtaggaacgacggacccggaaggtaaccgacggtctagtacctactacgtcgtacgagtagaacggtaggtcggggacttacggaggaactacgtaag

SEQ ID NO: 367503 - DNA, 682 bp, Homo sapiens
  misc_feature: GZ8MTXP02HLFYL.44.33.C11.1.454.CMB.2.raw
  modified_base (268)..(268): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggaggcgtggtccagcctgggacgtcctgagactctcctgtgtagcgtntggacttcaccttcaaacagacatggacatcgacctacgtcggggtcccgaccgaggccctacccgaagggaccgaaagggggaccgtggggaggttggggtacggtacctaacgtttataggtagggtatggtaaaggttaggaaaagttaaacttaaagttatttaagtacgttaagtacgtttaccggtaaggaaacgggtcccgtattacccgaactactcgtaacccgaagtacgaactaaacttcgaaaagaaccacaaagttataacttacgtaaaggaaaatagaaactacggcctagaacggacgtaccgggaaaggaaccgtacggtaccgttaggttacctaacgtcgttaggtcgacggtaagaaggtcggtacggggtcctacggtaggacttaacggaag

SEQ ID NO: 367504 - DNA, 623 bp, Homo sapiens
  misc_feature: GZ8MTXP02GOXTS.44.33.C11.1.454.CMB.2.raw
  modified_base (291)..(291): a, c, t, g, unknown or other
  modified_base (295)..(295): a, c, t, g, unknown or other
  modified_base (317)..(317): a, c, t, g, unknown or other
  modified_base (358)..(358): a, c, t, g, unknown or other
  modified_base (556)..(556): a, c, t, g, unknown or other
tcagacagtatatacacgaccggtgctcgatttagagtgagctcgttggggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcggtgggggaggcgtggtccagccgtggggacgtccctgagtactctcctgtgtagcgtctggtacttcaccttanaacngacatggcatgccacgtggccncaggctccgaggcgaagggactgggaggtggagctacttanagtgatgataggtaaattaaataagtattacgtgtaacgtacgttcggaagggaaacgggtactacttacaaccgtattacctacccgtaagtacgtaaactaacgttacgaaaacaactaacaacttaattaacgtagtaaaggtaaaacttagaaacgtacggactaagacggaacgaccgaggaacgtaccggtntagttacccgtattacgtacggagacggagtaaggacggtacggtccgtacgtaggacgtacgtaag

SEQ ID NO: 367505 - DNA, 619 bp, Homo sapiens
  misc_feature: GZ8MTXP02I22LE.44.33.C11.1.454.CMB.2.raw
  modified_base (322)..(322): a, c, t, g, unknown or other
  modified_base (356)..(356): a, c, t, g, unknown or other
tcagacagtatatacacgaccggtgctcgatttagagtgagctcgttgggtttgggggagctctgggagaggagcccagcaccagaagtcggcggtgtttccagtcggtgatcagccaccgaacacagaggactcaccatggagtttgggctgaccttgggttttcctcgttgcttcttttaagaggtgtccagtgtcaggtgaagcgtgggtggaggtcgtgggggagcggtggtccaggccgtgggacggtccctgacgtactctctgtcgtagcgtctggtacttcaccttcaacagacagtggcatcgcagtcggccncgaggctccgaggcaagggtactgggaggtgggngactagttatagtagtatggtaataggtaaattaaattaatattaagtcgtaagtacttaccggtagaacgggtcctattccactatcctacagacgaactaattaccgaaaagacaaacgtaacttaagtacttacgtagaaaatagaaattacggaccttaggaacgacggaacggaacgaccgaacgtccgttagtaccgttaacgacgtagtacggacgaaggtaaggtagggacggtccgtaggtacggaatacgaag

SEQ ID NO: 367506 - DNA, 664 bp, Homo sapiens
  misc_feature: GZ8MTXP02JZA9H.44.33.C11.1.454.CMB.2.raw
  modified_base (312)..(312): a, c, t, g, unknown or other
  modified_base (356)..(356): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacagaccagtggcatgccacgtcgggtccnccaggcctccgaggccaaaggggctggaggtgggtgctacttanacgtggtatgagtaggaaagttaaataatattagtagtagtattcccggtaggaacgggtcccgtaatttcccaaccgtacttaccgtacccgaaagacggtaaaccctaaagtttaccgaaaacgtaaacctaacaaaccttaaagtaactacgtaagggtaaaattagaaaacgtacggtaccttagggaacgaccggaccggaaaacggaccgaaccggggtctaggttacctaaaccgttacgtaggtcgacggtaaggaaggtagggtcgggggaccgtttacggaggttaacgacgtaaagg

SEQ ID NO: 367507 - DNA, 599 bp, Homo sapiens
  misc_feature: GZ8MTXP02GHOGQ.44.33.C11.1.454.CMB.2.raw
  modified_base (287)..(287): a, c, t, g, unknown or other
  modified_base (354)..(354): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagccgtgggacggtccctgacgactctcctgtgtagcgtctggattcaccttcaacngacatggcatgcacgtgggtccgccaggcctccgaggcaagggctgggagtggggtgctacgtttanagtggatgagttaggaaattaataattattacgtagtaagtattccggaggaacgggccctattacccgactatccgtacccaaggacgaactaaagttacgaaaacgaaccaactaactagtactacgtaggaaaacttgaaacttagacctaggaacggacgaccgaacggacacgggtctacgtacgtaactacgtggtacgcgaaggtaagaggtcgggggtcctggtacggaactacgag

SEQ ID NO: 367508 - DNA, 617 bp, Homo sapiens
  misc_feature: GZ8MTXP02GG328.44.33.C11.1.454.CMB.2.raw
  modified_base (276)..(276): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcgaggtgaagctgggtggagtcgtgggggagcgtggtccagccgtgggacggtccctgagctctcctgtgtagcgtctggtnttcaccttcaaacagacagtggcatgcacgtgggtccgccaggcctccgaggccgaagggcctgggaggtgggtggactacttagtagtggtatgaatagggaaattaaataagtattaatgtaagtattcgtagaacgggtccgtattccacctactctaccaagacgaataacgttaacgaaacgaaacaaacctaactaattaactacgtaaggtaaaatagaaaacgtgaccgtaggacgacgacccggaaagggaccacgggtcctaggtacctactacgttggacgacggaaggaagtacggtagggggtacctaggtacggtaagttaacaagg

SEQ ID NO: 367509 - DNA, 760 bp, Homo sapiens
  misc_feature: GZ8MTXP02IDE3F.44.33.C11.1.454.CMB.2.raw
  modified_base (564)..(564): a, c, t, g, unknown or other
  modified_base (655)..(655): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtgggtggagtcggtgggggaggcgtggccagccgtgggacgtcctgacgctctcgtgtgtacgcgtcgtggtacttccaccttacaaacagactagtggctagtcgacctacggtccggggtccccaccgacggtccgtaccggagggaccggaaaggggtcgtaggggtaggtggggtacgtacctaagtttagttacggtaggtaagtggtaaggttaaagggtaaaagttaaaatttaaatttagtttaaattacgggttaaagttaccggtttacggaagggtaaacccggggacctttactacccgaccctatcccgtaacgaaagaacgtaaactaaacgtaaccgggaaanaaacctaccgtaattaaattactaacggtaaaggtaaatagaaaagttccgacgtagggaaacggacccggaccggtaacgggaaaacccncggttacgtttaccgtaaacttaacccggttagttacgggtacggaaaccggaggtaaaccggtggggttcgggggtaccttaggggtagaacctttaagaaagg

SEQ ID NO: 367510 - DNA, 728 bp, Homo sapiens
  misc_feature: GZ8MTXP02IVCA7.44.33.C11.1.454.CMB.2.raw
  modified_base (432)..(432): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcgaggtgaagctggtggagtcgtgggggagcgtggtccagccgtgggagtccctgagactctcctgtgtagcgtctggacttcaccttcaacagacagtggaccatcgactacgtcgggtccccgcaggcctacccgaggcgaaaaggggtacttggggaacggttggggtacgtactaacgtttaagtacgtagggtatgggtaaattagggtaaaaagtttaaaataaagttttnttaaaggttacggttaacgttacgttaccgggtaagggaaaccgggtaccgttaacttacccgaaccgtaacttacccgtaacccgaaagtaaccgtaaacttaaacgtaaaccgaaaagaaacctaaaccgtaaacttaaattaacttaacgtaaaggtaaactaacgaaacgtacgtacgtaagacggtaacgacggaaacgaccgtaacggtacttacgtaaccttacgtacgttcgacggacggaaggtaacggtacgggtacgggtacgtaggtacggtaacgttacgaag

SEQ ID NO: 367511 - DNA, 784 bp, Homo sapiens
  misc_feature: GZ8MTXP02F2L56.44.33.C11.1.454.CMB.2.raw
tcagacagtatatacacgaccggtgctcgatttagagtgagctcgttgggtttggggagagaagacaggactcaggacgatctccagcatggccagcttccctctcctcctcaccctcctcactcactgtgcagggtcctgggcccagtctgtgatgtctcacgccaccctcagcgtcgtcgggacccccgggcgagggggtcaccgatctcttgttctggaaggaagtcaatatcggatcttatcctgtcaacgtggtagtcggggactcccgaggccacccggcccccgtactccttatcctagtcgaccttaactaactcgacgcccggtccctcggtaccggggtcccctacggtaccccgtacgtttcctcggttacggtcctaccgtaaacggttccgtacgggtacctaaccgtaacgacgggtacccttaaccgtcgggtcctaacgttcccgttagtaccgttcctaccgtacgttccgtagaacggtacgtcgggaacggtcctaaggttaactaccgttaacgttggacgtacgacgtacgtaggtagggtaacgtacgaaccggaacggggtaccgggtaaacgggttcgggtcggggtttacggggtaccgggggacggggtaaaccggggtaaacgtaacggggttccggtaacccggttaccggtacgggtaccgaacggtaccccggtaacggtccccgtacccggtcccccgttaccgggtaccctaaccgtcccgttacccggttacccccttaccgtttaacccg

SEQ ID NO: 367512 - DNA, 652 bp, Homo sapiens
  misc_feature: GZ8MTXP02IM7VY.44.33.C11.1.454.CMB.2.raw
  modified_base (266)..(266): a, c, t, g, unknown or other
  modified_base (307)..(307): a, c, t, g, unknown or other
tcagacagtatatacacgaccggtgctcgatttagagtgagctcgttgggtttggggagctctgggagaggagcccagcaccagaagtcggcggtgtttccagtcggtgatcagccaccgaacacagaggactcaccatggagtttgggctgacctgggttttcctcgttgcttcttttaagaggtgtccagtgtcaggtgaagctggtggagtcgtgggggagcgtggtccagcctgggagtccctgagctctctgtgtagcgtntggattcaccttcaaacagacatggcatgcacgtgggtccncgaggcctccgaggcgaagggcctggacggtggggtagctaacttatagtggtatggaataggaaagttaaataagttatttatacggtaagtagttaccggtaggtaaacgggaccgtattacccgaactatcctaccagacgaactaagtacgaaagaaccaactaacttaaatacttacgtaagggtaaaatacggaaactacggaccgttaggaacggaacggacccgggaaacggacccggtaacgggtaccgtacggttaccgttaaaccttacgttgggttacggaccggtaaggaaggcgttacgggggtactacggggttacggaagtactaaagg

SEQ ID NO: 367513 - DNA, 659 bp, Homo sapiens
  misc_feature: GZ8MTXP02JRU16.44.33.C11.1.454.CMB.2.raw
  modified_base (307)..(307): a, c, t, g, unknown or other
  modified_base (649)..(649): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctgggtggagtcgtgggggagcgtggtccagccgtgggacgtccctgagactctcctgtgtagcgtctggattcacccttcaacagacatggcatgcacgtcgggcccnccgaggcctccgaggaccgaaggggtacgtggggaacggttggggtcgacctaacgtttaatagttgggtaatggtaagttagggaaaagtttaaataaaagttatttagtggttaaacggtatttacccggggaaggaaacggggtcccgttaaagtttaccaacccgtatacccgtccgaaaggaacgtaaactaaacgttaacgaaaacgaaaccaactaaccttaaatacgttacgtaaggtaaatagtaaattaacgcgtaggaagacggaccgaggaccgtacggcctacgtacctactacgtggtacgacgacgagtacggtgggctcggagganacgagtatag

SEQ ID NO: 367514 - DNA, 599 bp, Homo sapiens
  misc_feature: GZ8MTXP02I6Y72.44.33.C11.1.454.CMB.2.raw
  modified_base (292)..(292): a, c, t, g, unknown or other
  modified_base (316)..(316): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcggtgggggaggcggtggtccagccgtggggacgtccctgagactctcctgtgtagcgtctggattccaccttcaacngacatggcatgcacgtcgggcccnccgaggcctaccgaggacgaagggacgtgggaggtggggtgcctagtttagagtggtatgagtaggtaaaagttaattaattattaagtagtaagtacgttaccgggaggtaaacgggtaccctagtttaccaaccctatcctaccgaagaaccgaaataacgttacgaaacaacaactaactaatactacgtaggtaaatagaacttagccgtagagacgacgagaccgacgtctatactatacgtagtcgagagaagaggtcgggctggtacgatacgaag

SEQ ID NO: 367515 - DNA, 631 bp, Homo sapiens
  misc_feature: GZ8MTXP02HBFSY.44.33.C11.1.454.CMB.2.raw
  modified_base (312)..(312): a, c, t, g, unknown or other
  modified_base (361)..(361): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgcttcttttaagaggtgtccagtgtcaggtgaagctggtggagtcgtgggggagcgtggtccagccgtgggagtccctgagactctcctgtgtagcgtctggattccaccttcaacagacagtggcatgcacgtcgggtcccnccgaggcctaccgaggacgaaggggtctgggagtgggtgctacgtttanacgtggtatggaagttaggaaaagtttaaataagtttattaacgttaggtaaagtagtttacccggtaggaaaaccggggtcctaattacccgacctatcctaccgagtacgaactaagtacgaaagacacgtactatatacgtaaggtaaattagaaagtacgccgtaggaacgacggaccgaagaaccgacgggtactaggtacctaacgtacgtggtacgacgtaagaaggtaggttacggggacttacgggaggtactaacgaagg

SEQ ID NO: 367516 - DNA, 612 bp, Homo sapiens
  misc_feature: GZ8MTXP02JO7FY.44.33.C11.1.454.CMB.2.raw
  modified_base (307)..(307): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggaggtccctgagactctcctgtgtagcgtctggattcaccttcaacagacatggcatgcacgtcgggtccnccagggcctccgaggccaaggggactggggagtggggtgctacttagtagtggtatggagtaggaaagttaaataaattattagtgtaagtatttccgaggtaacgggcctattccactactctaccaagtagaacaattacggaaacaaaccactaacttaagtactacgtaaggtaaacttagaaacttagaccctaggacgtacggaccggaaggaccacgggtcttacggtactacgtacgtaggtacgacgaggaggtacggtgggggtccgttacggtggaacttacgaagtattaacg

SEQ ID NO: 367517 - DNA, 645 bp, Homo sapiens
  misc_feature: GZ8MTXP02JBT2P.44.33.C11.1.454.CMB.2.raw
  modified_base (313)..(313): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggacggtccctgagactctcctgtgtagcgtctggacttcaccttcaacagacagtggacatcgacacgtcgggtcccnccgaggcctaccggaggaccgaaagggcgtggggacggtggggtcgcctagttatagtgtagtgtaagtaggaaaattaaataaattattagtacgtaagtacgtttaccggaggtaacggggtccttaatacccgaactactaccgtaccgaagaacgtaaactaacgttaacgaaaacgaaaccaactaacttaatacttagtaaaggtaaataagtaagtacgtaccgtagaacggacggaccggaacggacgacggacttacggttactacgttacgtgtaggacgaggtaggaggtcggggtactcggacgtagtacaggtactaag

SEQ ID NO: 367518 - DNA, 658 bp, Homo sapiens
  misc_feature: GZ8MTXP02FWNXR.44.33.C11.1.454.CMB.2.raw
  modified_base (304)..(304): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggaggtccctgagactctcctgtgtagcgtctggattcaccttcaacagacatggcatgcactgggtccnccaggcctccgaggcgaagggcctggagtggggtgctaacttagtagtggtatagtagtaggtaaaaggttaaattaaaattatttagtacggtaagttaacgtttccggtagggaaacggggtccgtaacgttaccaccctacttaccgtacccaaggtaacgaaactaaacgttaacgaaacgaaaccaaactaactaaattaactactaaggtaaaattagtaaacgtaagtacccgtaggacgaacggaccgggaaggaaccgacgggacttacggtactaaccgttacgtaggtcggtacgacggaaggtagtcgggggtcctacgggtacggtatacgaagagttaag

SEQ ID NO: 367519 - DNA, 685 bp, Homo sapiens
  misc_feature: GZ8MTXP02FW0QT.44.33.C11.1.454.CMB.2.raw
  modified_base (207)..(207): a, c, t, g, unknown or other
  modified_base (459)..(459): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtctcgggaccccggngagggggtcaccatctcttgtctggaagagtccaatatcggattcttatcctgtcaacgtggtacgtcggggactcccgacggccacccggccccccgtaactccctttaatcctaatcgacttaactaactcgagcccggccctcggacgggtccctcgcccgtattcctcgtcggctaccgagtcgtcgctactacacggtcctaccgtggacctattccttagtactcctacgtagtccgtagaaggtntcggacgggacttagtaactttaccggacttggtacgaccgtaaggcgtaaagtggggtaactacggaaccgtaccgggaaccgggtacggggtcgggttacgggggttaccgggtacggggaccgggtaaacggggtaaccttaacgggttacccgggtaccggttaccggtaacggtaccgtaaaccggacccgtaacggtcccgttaccccgtaccccgtcgg

SEQ ID NO: 367520 - DNA, 543 bp, Homo sapiens
  misc_feature: GZ8MTXP02GG9P7.44.33.C11.1.454.CMB.2.raw
  modified_base (516)..(516): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtctgggggaggcgtggtccagcctgggagtccctgagactctcctgtgtagcgtctggattcaccttcaaacagacatggcatgcacgtgggtccgccaggcctccgaggcaaaggggactgggacggttgggtggcaacgtttatacgtggtatgatggaaagttaaataatattagtgtaacgatttccgtagaaagggtccgattcacctaatctaccagagaacaattacgaaagaacacactaatatctaggaaatgaatagctgagagcgagacacggctcgtactactactcgtacgngtagaagagtgggctaggtgatacaag

SEQ ID NO: 367521 - DNA, 667 bp, Homo sapiens
  misc_feature: GZ8MTXP02JODR7.44.33.C11.1.454.CMB.2.raw
  modified_base (262)..(262): a, c, t, g, unknown or other
  modified_base (267)..(267): a, c, t, g, unknown or other
  modified_base (284)..(284): a, c, t, g, unknown or other
  modified_base (310)..(310): a, c, t, g, unknown or other
  modified_base (402)..(402): a, c, t, g, unknown or other
  modified_base (592)..(592): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccagccgtgggacgtccctgagactctctgtgngcgtntggattcaccttcaacngacagtggcatgcacgtcgggtcccnccgaggccctccgaaggtccgaaaggggcgtgggagtggggttgacctagtttatgtggtatagaagtagggaaattaaattaagtatttanacggttaatacgttccgggtaggaaccgggtacgtaacttaccgacctatccctacgaagtaacggaactaacgttaaccggaaactaaactaacctaacttaaagtaacttacgaaaggggttaaaactaagtaaaacgttaacggtaccgtaggaaacgaccggaaccgggaacggacgtaacccggnttacgttaccgttaactacgttcgtaggacgaggtaacgtaggggtcgggtctacggtacggtaagtacgaaagg

SEQ ID NO: 367522 - DNA, 684 bp, Homo sapiens
  misc_feature: GZ8MTXP02IO0GQ.44.33.C11.1.454.CMB.2.raw
  modified_base (280)..(280): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgaagctggtggagtcgtgggggagcgtggtccaggccgtgggacggtccctgagactctcctgtgtagcgtctggattcaccttnaacagacatggcatcgcacgtcggtacccgccagggcctcccgaagggcccgaaaaggggaccgtggggaggttggggtacggtaccaacgttttaagtagttgggttagttaggattaggggaaatttaaaattaaaagttaatttagtcgtttaaagacgttttcccgggaaggtaacgggggtacccctattaccaacctaacttcccgtaaccaaggtaactaaacgtaaactttaaccgaaaacgtaaaccactaacttaaattacttacgtaaaggtaaatagtaaagtaacgtccgtagaacggagaccggaagtacgacggcttacgtaccttacgtaccgtaggtcggtacgagaggagtcggggtcgtacggtaggaactagacggtattaagg

SEQ ID NO: 367523 - DNA, 567 bp, Homo sapiens
  misc_feature: GZ8MTXP02HWO8G.44.33.C11.1.454.CMB.2.raw
  modified_base (267)..(267): a, c, t, g, unknown or other
  modified_base (306)..(306): a, c, t, g, unknown or other
  modified_base (340)..(340): a, c, t, g, unknown or other
  modified_base (347)..(347): a, c, t, g, unknown or other
  modified_base (370)..(370): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggaggtccctgagactctctgtgtagcgtcnggattcaccttcaacagacatggcatgcacgtgggtccnccaggcctccgaggcaaaggggctgggagtgggngcattanatggtatgatggaaattaatatnttaatgtagtattcggtagaacgggccgtataccacctaatcctaccagacgaactaatacgaaagtaaacactaacttataactacgtaggaaatagaaatagacctaggagacggaccgaggaacacgggacttgtactacgtactaggtcgacggaggaagtacggtgggggtctacggtaggacttaacgaag

SEQ ID NO: 367524 - DNA, 611 bp, Homo sapiens
  misc_feature: GZ8MTXP02IR3XR.44.33.C11.1.454.CMB.2.raw
  modified_base (276)..(276): a, c, t, g, unknown or other
  modified_base (280)..(280): a, c, t, g, unknown or other
  modified_base (302)..(302): a, c, t, g, unknown or other
  modified_base (341)..(341): a, c, t, g, unknown or other
  modified_base (381)..(381): a, c, t, g, unknown or other
  modified_base (456)..(456): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggtttcctcgttgctctttaagaggtgtccagtgtcaggtgaagctggtggagtcgtgggggaggcgtggtccagccgtgggagtcctgagctctctgtgtagcgtctggattcaccttnaacngacatgcatgcacgtgggtccncaggcctaccgaggcgaaaggggctgggaggtacggggnggcctaagtttatagtggtatgaagtcggaaataataatnttatagtagtatttccgaggaacgggtccgattacactatctacagacactaattacgaaagaacacaaacttanaacttcaagggtaaactacgaaatacggacctagaaacggaacgtaccgggaaggaccgtaacgggtacttaggtaccttaccgtacgttaggtaccgacggtagtaacggacggttacgggggtaccttacgggtaggtaccggtaactaaagg

SEQ ID NO: 367525 - DNA, 675 bp, Homo sapiens
  misc_feature: GZ8MTXP02JQP47.44.33.C11.1.454.CMB.2.raw
  modified_base (280)..(280): a, c, t, g, unknown or other
  modified_base (371)..(371): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggagtccctgagctctctgtgtagcgtctggattcaccttnaacagacatcggcagtgcctacggtcgggtcccgccgaggtcctaccgagggccaaaggggtacctgggacgttggggtcgactactttanacgtaggtatagaagttaggaaattaagtaattagttagtaggttaacgtacgtttccggaagggtaacggggtacctattacccgacctaagttccctaccgaagtaacgtaactaaacgttacgaaaacgtaactaactacgttaaatacttacgtaagggtaaaattacgaaaacgttacgtaaccgtagaacggaacggaccggaaaggtacccaacgggtcttaggtaccctacgttacgtgtacggacgtaaggaacggtaacggtcggggtacgtacggtaggaaccttacgtaaag

SEQ ID NO: 367526 - DNA, 815 bp, Homo sapiens
  misc_feature: GZ8MTXP02JWJWW.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcacgcccaccctcagccgtccgtcggggaccccccgggcgacgggggtccaaccgatccttcgttgttcgtagggaaaggaacgtaccaaagtagtcggtatcttactcctgtactaactggtacgtcgggacctcccgaggccacccggccccctactcctatctatgctactatcgacgccgtcctcgtacgggtccctcgcccgtattcccgtcgtcgtcctaccgacgttcgtcggcctacgtacgacggtcctaccgtcggacccttacgtcccgttacgtaccttcccgtaccgtacggtccgtaggtaacggtacgttgggaaccggttccttaagttaaaccgtttacccggtaaagtttcgggtaccgtaccgacgggtaacgtaacgggtttaggggaaccgttacgggaaacccggtaccgggggtaacccggggtaaaacggggttccgggtttcgggggttacccggggttaaccgggggaccggggtaaaacccggggtaaaccggttacgggttacccggttacccccggttaaccggtttaaccggggaccccgtaaacccggggtacccccgggtaaacgggttcccccggttaccccccggtcccccggttttaaccccgg

SEQ ID NO: 367527 - DNA, 788 bp, Homo sapiens
  misc_feature: GZ8MTXP02I2HMK.44.33.C11.1.454.CMB.2.raw
  modified_base (291)..(291): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcgtgggggagcgtgtccagccgtgggacgtccctgagtactctcctgtgtagcgtctggacttcaccttacaaacngacagtggaccagtcgaccgacggttcgggtcccgaccgacgggtccctacccggaaggggaaccgtaaaacggggtaccgttaggggaggtttcggggtacggtaccttaaacgttttaagtaacggttaggtaagtaggtaaagttaagggtaaaaaagtttaaattaaagtttatttaagttaggttaaacgtaccgtttaccgggtaagggtaaacccggggtacccttaaatttcccgaaacctacgtacccgtaaccgaaagtaacgttaaacgtaacgtttaaaccggaaaaacaaacctaaacccgttaaacttaaagttaacgttaccggtaaagggtaaaattaacgaaaacgttacggccgttaggaaaacgggaccgaaccgggaaagtacccggtaacggtcgttaaaggtaccccttaaagtcgttaggaccgacgtaaaggaagtcgggtacgggtaccgtcggtaaggaacttaacgtaag

SEQ ID NO: 367528 - DNA, 532 bp, Homo sapiens
  misc_feature: GZ8MTXP02FHLG9.44.33.C11.1.454.CMB.2.raw
  modified_base (285)..(285): a, c, t, g, unknown or other
  modified_base (344)..(344): a, c, t, g, unknown or other
  modified_base (417)..(417): a, c, t, g, unknown or other
  modified_base (499)..(499): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagcctgggaggtccctgagactctcctgtgtagcgtctggattcaccttcaacngacatggcatgcactgggtccgccaggctccaggcaagggctggagtgggtgcacttanacgtggtaatgatggaaagtaataatattaatgtaagattcggtgaaagggccgattcaccatctccagaganaaacttcgaaacgaaacaacactaatatctaggaaaatagaatagctgagagccgagacacggctgtctaactactgtacgngaagaagagtggggctacggtggaactacgaag

SEQ ID NO: 367529 - DNA, 694 bp, Homo sapiens
  misc_feature: GZ8MTXP02I6R5K.44.33.C11.1.454.CMB.2.raw
  modified_base (249)..(249): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctccaccctcctcactcactgtgcagggtcctgggcccagtctgtgatgtctcacgcccaccctcagcgtctcggggaccccgggcgagggggtcaccatctcttgttctggaagagtccaatntcggatctatctgtcacgtggtactcgggactcccgacggccacccggcccccgtactcctttactctatcgactactaactcacgcccgcctcgacgggtcctcgccgtatcctcgtcgctaccgagtccgtggccactacgcgtcctaccgtcgcctacttcccttagcttcctcgtacgttcgtacgaggtgtacggagtccttaggtactttacgttacgttcggtacgtaccgacggtaccgaggttaggggtacttacggtaaccggaaccggggaccgggggtaaacgggtccggggttagggggttccggggtttaccgggggaccggggtaaacgggtaaacccggttaacgggttcccgtaaacccggttccggtaacggtaccgtaaccggacccggaaacgggttcccgtaccccggttacccccggtttcgg

SEQ ID NO: 367530 - DNA, 629 bp, Homo sapiens
  misc_feature: GZ8MTXP02FT1VL.44.33.C11.1.454.CMB.2.raw
  modified_base (286)..(286): a, c, t, g, unknown or other
  modified_base (368)..(368): a, c, t, g, unknown or other
  modified_base (381)..(381): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcgaggtgaagcgtggtggagtcgtgggggagcgtggccaggccgtgggacgtccctgagctctcctgtgtagcgtcgtggacttcaccttnaacagacagtggacagtcgactacggtcgggtcccgccaggcctaccggaagggccgaaaggggcgtggggagggttggggngacctaagtttanacggttggtatggaacgttaggaaaattaaattaatagttagttacgtagtacgttacggaggaacgggtcctagttaccactacgtctacgaagtacgtaactaaagtacgaaaacgactaactaactaatacgttagaaggtaaatagaaacttacgactaggagaccgacggaggactacggcttacgtctaacctaggtcgtacgacgtagaaggtacggtgggtcgtaggcggtaactagaag

SEQ ID NO: 367531 - DNA, 572 bp, Homo sapiens
  misc_feature: GZ8MTXP02F1XKH.44.33.C11.1.454.CMB.2.raw
  modified_base (286)..(286): a, c, t, g, unknown or other
  modified_base (348)..(348): a, c, t, g, unknown or other
  modified_base (395)..(395): a, c, t, g, unknown or other
  modified_base (430)..(430): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcgaggtgaagctggtggagtcggtgggggaggcgtggtccagccgtgggacggtccctgagactctcctgtgtagcgtctggattcaccttnaaacagacatggcatgcacgtcggtccgccaggctccgaggcgaagggctgggacggtgggngctaacgttatagtggtatgataggaaattaataatattatgtaagnttcgagaaggaccgtattacaccatcctacaaganaactaagtacgaaaagaacaaacaataatagtactaggaaaatagaaatcgactagaacgagaccgagaacgacgacgtgtacctaatacgtacgtagacgaagaagtaggtcggggtactagggtacggtaataacgtaag

SEQ ID NO: 367532 - DNA, 551 bp, Homo sapiens
  misc_feature: GZ8MTXP02IHE9E.44.33.C11.1.454.CMB.2.raw
  modified_base (277)..(277): a, c, t, g, unknown or other
  modified_base (305)..(305): a, c, t, g, unknown or other
  modified_base (541)..(541): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggagtccctgagactctcctgtgtagcgtctggattcaccttnaacagacatggcatgcacgtcgggtccnccagggcctccgaggcaagggactggaggtggggtgctacttatagtggtatgataggaaagttaataaatattatgtaagatttccgagaaggggcctattccacatctaccagaacgactaagttacgaaagaacaacactaatactactaggaaatgaaatacgactagagagaccggagacacggctcgtactactacgtgtacgcgaagagtagtggggctaggtacgganacgagataag

SEQ ID NO: 367533 - DNA, 614 bp, Homo sapiens
  misc_feature: GZ8MTXP02HBQLA.44.33.C11.1.454.CMB.2.raw
  modified_base (285)..(285): a, c, t, g, unknown or other
  modified_base (309)..(309): a, c, t, g, unknown or other
  modified_base (340)..(340): a, c, t, g, unknown or other
  modified_base (349)..(349): a, c, t, g, unknown or other
  modified_base (376)..(376): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagcctgggagtccctgagctctcctgtgtagcgtctggattccaccttcaacngacatggctatgcacgtgggtccncaggctccgaggcaagggctgggagttgggngcacgttanagtggtatgatagggaaataataattnttatgttacgatttccggaggaagggtccgtattaccacatactccagacgactaacgttacgaaacgaacaacgaaccttaattacgtacgtaagggtaaattagaaagtacggtaccttagaaggaacgaccggaaggaacccgacggtactacggtacgttaaaccttacgtacggttacgtaggaacggaaggtaacgtcggggggtactccgggtacggtaacttacggaaag

SEQ ID NO: 367534 - DNA, 653 bp, Homo sapiens
  misc_feature: GZ8MTXP02FYLCD.44.33.C11.1.454.CMB.2.raw
  modified_base (210)..(210): a, c, t, g, unknown or other
  modified_base (429)..(429): a, c, t, g, unknown or other
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtctcggggacccccgggngagggggtcaccatcttcttgttctggaaggaagtccaatatcggatcttatcctgtcaactggtatcggggactcccgaggccacccggcccccgactccttatctatcgctactaatcgagccgccctcgacgggtccctgccccgtattccctcgtcgctccgtaagtcctgggccactacgacggtcctaccgtgacctacttccttgacttccncctagtcgtagacggatgacggtctagtaacttactacgttgtcgacgtagtacgagtgggaatacggaacgacggacccggggaacggtcggttcgggggttcgggttaccggggacggggtaacgggtaaccgttaacgggttaccggacccggtttaccgtaacggggttcccaaccggtaccccgaaacggtcccgtccccggtaccccgtttacccggg

SEQ ID NO: 367535 - DNA, 580 bp, Homo sapiens
  misc_feature: GZ8MTXP02I7G1M.44.33.C11.1.454.CMB.2.raw
  modified_base (312)..(312): a, c, t, g, unknown or other
  modified_base (386)..(386): a, c, t, g, unknown or other
  modified_base (423)..(423): a, c, t, g, unknown or other
  modified_base (434)..(434): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagctggtggagtcgtgggggagcgtggtccagccgtgggacgtccctgagactctctgtgtagcgtctggattcaccttcaacagacagtggcagtgacacgtcgggccnccgaggcctccgaggcaaggggctgggaggtgggtcgctacgttagtagtggtatgagtaggaaattaatagtnttatgtagattcgaggacggctattcacatcacaganacaatcgaaanacacactagtactctaaggaactagaactacgactaggaacggtacgaccggaagaccgtaacggcgttacggtacttaacgtacgttggtaacggcgtaaaggcgtaaggggtccggggtactacgggtaggtaactacgtaagg

SEQ ID NO: 367536 - DNA, 630 bp, Homo sapiens
  misc_feature: GZ8MTXP02I6GWH.44.33.C11.1.454.CMB.2.raw
  modified_base (290)..(290): a, c, t, g, unknown or other
  modified_base (311)..(311): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcgtgggggagcgtggtccaggccgtgggacgtccctgagtactctctgtgtagcgtctggattccaccttcaacngacatggcatgcacgtggccncaggctaccaggcgaagggctggaggttgggtcgctacgttatagtggtatgaataggaaagttaaataattagttaatcgtaagacgtttccggaggaacggtccgtattaccaaccgtatcctaccgaagacgaactaacgttacgaaagtaaccaaagtaccttaaagtaacttacgtaaaggtaaatacgaaagttacggaccttaggaaggacgaccggaacgaacgaccggtcgtacttaccgtaacgtaactcggtacgaccggaacggaacggtaggtcggggacctacgggtaggtaaccgtaacgaagg

SEQ ID NO: 367537 - DNA, 763 bp, Homo sapiens
  misc_feature: GZ8MTXP02ITFZD.44.33.C11.1.454.CMB.2.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggaccccgggcgagggggtcaccatctcttgttctggaagagtccaatatcggtatcttatcctgtacaacgtgtacgtcgggacctcccgacggcccgaccggccccccgaccttcccttatccttagtcgaccttaactaactcgacgcccggtcccgtcgaccgggtccctcgcccgtacttcccctcgtcgcctacgagttcctcggcacgtacgacggtaccctacccgtcgccttacttccgttagaccttcctccgtaagttccgtaggacggtaagtggtacgggtacgttaggttaactttaaccgttaacggttcggttacgtacccgagggtaccgtagggtttaaccggggagtttacggaaaccggaccgggggtaacccggggtaaacggggttccggggtttggggggtttccgggttaccgggggaccgggggtaaaccggggtaaacccggttacgggttaaccgggtaccccgttaccggttaacgggtacccgacccgggtaacccggtaacggtcccccggtcccggtaccccccgtttacccgg

SEQ ID NO: 367538 - DNA, 705 bp, Homo sapiens
  misc_feature: GZ8MTXP02GW72Q.44.33.C11.1.454.CMB.2.raw
  modified_base (254)..(254): a, c, t, g, unknown or other
  modified_base (278)..(278): a, c, t, g, unknown or other
  modified_base (292)..(292): a, c, t, g, unknown or other
  modified_base (294)..(294): a, c, t, g, unknown or other
  modified_base (655)..(655): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcaggtgaagcgtggtggagtcggtgggggaggcggtggtccagccgtgggacggtcccngacgtctcctcgtgtgtgtcgtgngtctctacctacananactagtcgactagtcgacgtccggtcggcccgccgacgtaccgacggagggaacggaacgggtcggtagggtagggtcggggtactacgttaacgttagtaggtttggtagtaggtaaagttaaggtaaaagttaaaattagttaacttagtacggtttaagttaccggtttacgggaggtaaaccgggaccttaacttaccaaacccgttgtaccgaacgtaagaaacgtaacctaaacggtaacgaaaacgtaaccctaaacgtaactttaatacggttaagtaaaggttaataagaactacggtaacgtgaaacggacgtaacggggacgtaaccggacggttctcggtaactaccgngttacggacgtagagtaaggacgggtcggtacagggtagtacgtaagtag

SEQ ID NO: 367539 - DNA, 844 bp, Homo sapiens
  misc_feature: GZ8MTXP02HSLDJ.44.33.C11.1.454.CMB.2.raw
  modified_base (269)..(269): a, c, t, g, unknown or other
  modified_base (287)..(287): a, c, t, g, unknown or other
tcagacagtatatacacgaccggtgctcgatttagagtgagctcgttgggtttgggggagctctgggagaggagcccagcaccagaagtcggcggtgtttccagtcggtgatcagcaccgaacacagaggactcaccatggagtttgggctgaccttgggttttcctcgttgctcttttaagaggtgtccagtgtcaggtgagctggtggagtcgtgggggagcgtgtccagccgtgggacggtccctgagactcctctgtgtagcgtntggattccaccttcaacngacagtggcagtcgactacgtcggggtccccgccagggccctcccgaagggccggaaaacggggtctaggggtacgggttgggggtacggtacctaagtttaataggttaggggttacttagggaaggtttacgggtaaaagtttaaaagttaagttaattttaaggtacgttaacggttaacgtttccccggggaagggttaaacccgggggaccttaacggtttacccgaaccccgttaattacccccgtaacccgtaaacgggtaacgtaaaccgttaaacggtttaaccggaaaaaccggtaaaccctaaacccgtaaaccctttaaagttaacgtttaaaccggttaacgggtaaaaaagtttacccggtaaaagttaacccggtacccgttaaagggaaaggacccggggaacccggtaaacggggtaaaccgacccgggtaccgtttaccggtaacccttaaaccgttcggtacgggttaccggaggtaacggaaggtaacggggtccgggggtacgttaacgggttaccggggaaactttacgggaaag

SEQ ID NO: 367540 - DNA, 601 bp, Homo sapiens
  misc_feature: GZ8MTXP02GBWC6.44.33.C11.1.454.CMB.2.raw
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgagaggtccctgacgactctcctgtgtagcgtctggacttcaccttcaacagacagtggaatgcacgtcgggtccgccgaggcctccgaggccgaaggggctgggaggtgggtgctaacgtttatagtggtatagagtaggaaattaaataattattagtagtagtagtttccgaggaacggtccgtattccactatcctacagacgaactaagtacgaaacaacaactaactaatatacgtaaggaaaataggaaactagaccgtagaacggacgaccgaaggaaccgacgggtcttaggtacctttacgtacgtggtacgacgtaaggaagtaggtcggggcttacgggtaggtaactacgaag

SEQ ID NO: 367541 - DNA, 567 bp, Homo sapiens
  misc_feature: GZ8MTXP02HZZ7U.44.33.C11.1.454.CMB.2.raw
  modified_base (292)..(292): a, c, t, g, unknown or other
  modified_base (342)..(342): a, c, t, g, unknown or other
  modified_base (513)..(513): a, c, t, g, unknown or other
  modified_base (532)..(532): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggaggcgtggtccagccgtgggaggtccctgagactctcctgtgtagcgtctggattccaccttcaacagacanggcatgcagtcgggtccgccaggcctccaggcaaagggctgggagtgggnggccagttatagtggtatgaataggaaagttaaataagtattatagtagtaatttccggagtaaacgggctatcgaacctatcctaccagaacgtacaaagttacgaaagaaacaaccaattaactaatacgtaagaaaattgaaatagcgtagagacgacgagacgacgntcgactactacgttgacgngaggaagtcgggcggtcgtacggtagaactacgag

SEQ ID NO: 367542 - DNA, 725 bp, Homo sapiens
  misc_feature: GZ8MTXP02JDY9J.44.33.C11.1.454.CMB.2.raw
  modified_base (285)..(285): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgaccttgggttttcctcgttgcttctttaagaggtgtccagtgtcaggtgaagctggtggagtcggtgggggaggcgtggtccagccgtgggacgtccctgagactctcctgtgtagcgtctgattccaccttacaacngacagtcggcagtcgctacgtcgggtcccgccacgggtcctaccggaggacgaacggggtaccgtggggtagggttggggtacgtacctaacgtttagtagtaggtactaggtaacgtaggggtaaattaaataaaagttatttagtagtaacgtacgtttcccgggaaggtaaccgggtaccgtaactttacccgaaccttacgttccctaaccgaacgggtaaactaaccgtaaacgtttaaaccggaaaacgtaaacctaaacctaacttaaatacttaacggtaaagggttaaactaagtaaagttaacgaccgtaggaacggaccggaacgtaacggaccggtacgtctaacggttactacccgtacgtggttacggacgacggtaagtacgggtcggggtacgttacggtacggtagtaaccgtagtacgtaag

SEQ ID NO: 367543 - DNA, 705 bp, Homo sapiens
  misc_feature: GZ8MTXP02HPY9N.44.33.C11.1.454.CMB.2.raw
  modified_base (264)..(264): a, c, t, g, unknown or other
  modified_base (309)..(309): a, c, t, g, unknown or other
tcagacagtatatacacgaccggtgctcgatttagagtgagctcgttgggtttggggctgggagaggagcccagcaccagaagtcggcggtgtttccagtcggtgatcagcaccgaacacagaggactcaccatggagtttgggctgacctgggttttcctgttgcttcttttaagaggtgtccagtgtcaggtgaagctggtggagtcgtgggggagcgtggtccagccgtggggagtccctgagactctcctgtgtagcgtntggtattccacccttacaacagacagtggcatgcagtgggtcccnccgaggcctcgaggcaaggcgtggagtggggtcgctaacttatagtggtagtagacgtaggaaaagttaaattaaaagttatttacgtaggttaacgtaacgtttaccggtaagggtaaacggggtcctaaagtttacccaaacctactttacccgaccgtaaggaacgtaacctaaagttaaccgaaaacgtaaccaactaaactaattaacgtaccgtaaggtaaaatagtaaaacgttacgaccgtagaaacggtaacggacccgtaaaggtaccgaacgggtaccttacggtacctttaaaacgtccgttaggtacccggacggaaacgtacgggtaaggtcgggggtcccttaacggtagggaaaacctttacgggaaactacggttaaag

SEQ ID NO: 367544 - DNA, 704 bp, Homo sapiens
  misc_feature: GZ8MTXP02HGYNJ.44.33.C11.1.454.CMB.2.raw
  modified_base (412)..(412): a, c, t, g, unknown or other
  modified_base (669)..(669): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgaccttgggttttcctcgttgcttcttttaagaggtgtccagtgtcgaggtgaagctggtggagtcgtgggggagcgtggtccagccgtgggacgtcctgagactctctgtgtagcgtctggacttcaccttacaaacagacatggactatcgcacgtcgggtcccgacgacggctacccggaggcgaagggtacgtgggaggtggggtgcctagttagtagtggtagtagtagttacgaaagttaactaagttacttaagngacgtacgtacttccgggtagaaccgggtaccgtaacttcccaaccgtaacttacccgaaccgtacggaaataaacccgttaaacttaaccccgaaaaggtaaacccacgttaaccgttaggttaaactccgttaacggaaactaaaacgttacgaaacctaacggtccgtagaaacggacgtacccggaaacggtacccgtacccgggtcgtttacggttaactagttaaccgtggtacgaaccgtaaggacgttnttaaaccgtttcggtaacgttaacccttaacccgg

SEQ ID NO: 367545 - DNA, 668 bp, Homo sapiens
  misc_feature: GZ8MTXP02JBF10.44.33.C11.1.454.CMB.2.raw
  modified_base (309)..(309): a, c, t, g, unknown or other
tcagacagtatatacacgaccggtgctcgatttagagtgagctcgttgggtttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtccctgagactctcctgtgtagcgtctggacttcaccttcaacagacatggcatgacacgtggggtccnccgaggcctccgaggcaaggggactgggagtggggtgctacttagtatggtatgatcggaaagttaaatactattatagtacgtagttaccgtagggaaacgggcgtagttacaacctagtcctacccaaggactaaacgtaaattacggaaataaaccaaacaaaccttaagttaacttaccgttaaggtaaaacgttaacggaaagtacgtacccgttaaggaaacggtaacggacccgggaacggggtaacccgaccgggtaccgttaacggttcccttaaacgttaccgtagttacgggaccgaagtaacgggaggttacgggggaccgttcgggtaggtacgtaaccgtaaagg

SEQ ID NO: 367546 - DNA, 532 bp, Homo sapiens
  misc_feature: GZ8MTXP02GGYJ3.44.33.C11.1.454.CMB.2.raw
tcagacagtatatacacgaccggtgctcgatttagagtgagctcgttgggtttgggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggaagtccaaatatcggattcttatcctgtcaactggtatcggggactcccaggcacggcccccgactcctatctatgctactaatcagcggccctcacggggtccctgcccgtattcctctcggctccaagtctgcactacaggctacctggccactccttgatctccgatcctgaggatgagctgaattactactgtcgcagcagtgggatgaacagccgggaacgctgggtgttcgggcggacgggaccaagttcgaccgtctaacggtcacgcccaaggcctcgtcccctccgg

SEQ ID NO: 367547 - DNA, 565 bp, Homo sapiens
  misc_feature: GZ8MTXP01EIDNX.19.57.F02.1.454.CMB.2.raw
  modified_base (255)..(255): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtancagcagaaagcgaacgggaaaccccctaagctcctgatctatggtgcatcctacgtttggaaacggttcggggtcccctcgaaggttccaggcggcaggtggaatcgtgggacagtatttcactctcgccatcagcagcctgaccagactagaagtatttgacttaactttattttgtactaactacggtacttaacctaccctttcccctactaccgtttcgggacggtacgggtaaccgaagggttcggagacgttacgaagcgaacgttgttacggctcgcctacacttcgttaacgttctttaacc

SEQ ID NO: 367548 - DNA, 587 bp, Homo sapiens
  misc_feature: GZ8MTXP01EZK80.19.57.F02.1.454.CMB.2.raw
  modified_base (254)..(254): a, c, t, g, unknown or other
  modified_base (323)..(323): a, c, t, g, unknown or other
  modified_base (391)..(391): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtancagcagaaagcaagggaaaccccctaagctcctgatctatggtgcatccatttggaaagtgggtccctnaaggttcagcggcagtggaatctgggacagatttcactctcgccatcagcagcctgcagactgaagtntttgacttaactttatttttgtactaaacaggtacctaaacctaccgttttccccctacgtaaccgttttccgggaccggtaacggggaacccgtaaaggggttcgggaaaggtattaccgaaaggacccggttaaaacgttggttacgggcccttaggcccgaaacccgttacgttccgttcgtttccttaaccg

SEQ ID NO: 367549 - DNA, 595 bp, Homo sapiens
  misc_feature: GZ8MTXP01CQGWI.19.57.F02.1.454.CMB.2.raw
  modified_base (255)..(255): a, c, t, g, unknown or other
  modified_base (328)..(328): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtagagacagagtcaccatcacttgtcgggcgagtcaggatattagggcgctcgttaggctggtancagcagaaagcacgggaaaccccctaagctcctgatctatggtgcatccactttggaaagtcggggtcccctnaaggttccagcggcagtggaatcgtgggacagatttcactctcgccatcagcagcctgcagactgaagtatttgacttaaactttagtttttacgttactaaactaggtaccttaaacctacccttttccccctactaaccgttttccgggacgggtaacggggtaacccgaaagggttcgggaagtaagttccgaaaaggtccggttaaaacgttggttacgggcttcggaacctaccctagttccttcggttccgttttaacccg

SEQ ID NO: 367550 - DNA, 610 bp, Homo sapiens
  misc_feature: GZ8MTXP01ASKQ3.19.57.F02.1.454.CMB.2.raw
  modified_base (196)..(196): a, c, t, g, unknown or other
  modified_base (253)..(253): a, c, t, g, unknown or other
  modified_base (324)..(324): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcagtcaggatattaggcgctcgttaggctggtancagcagaaagcagggaaaccccctaagctcctgatctatggtgcatccactttggaaagtcggggtccctnaaggttccaggcggcagtggaatcgtgggacagtatttcgactctcgccatcagcagcctgacagactgaagtatttgctaaactttagttttacgtacaaactacggacttaaacctaccttttccccctactaaccgttttccggggacggtaacggggtaacccgtaaaggggttcgggaaacggacttaccggaaaaggtcccggttaaaaccgttgggttaacggggccttacgggaacccgtaacccctaagttacccctttggttcccgttttaacccg

SEQ ID NO: 367551 - DNA, 522 bp, Homo sapiens
  misc_feature: GZ8MTXP01BHOX1.19.57.F02.1.454.CMB.2.raw
  modified_base (254)..(254): a, c, t, g, unknown or other
  modified_base (324)..(324): a, c, t, g, unknown or other
  modified_base (512)..(512): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaagggaaaccccctaagctcctgatctatggtgcatccactttggaaagtgggtccctnaaggttcagcgcagtcggaatctgggacagatttcactctcgccatcagcagcctgcagactgaagattttgactaaactttattttgtacaaacaggtacctaaacctacctttccccctataccgtttcgggacggaacgggaccaagggtgagtattcgaaagcgaacgttgttggctgcacctnttctgttctc

SEQ ID NO: 367552 - DNA, 543 bp, Homo sapiens
  misc_feature: GZ8MTXP01CMXRF.19.57.F02.1.454.CMB.2.raw
  modified_base (239)..(239): a, c, t, g, unknown or other
  modified_base (254)..(254): a, c, t, g, unknown or other
  modified_base (324)..(324): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgntcgttaggctggtancagcagaaagcagggaaacccctaagctcctgatctatggtgcatccactttggaaagtcggggtccctnaaggttccagcggcagtggaatcgtgggacagatttcactctcgccatcagcagcctgcagactgaagtatttgactaaactttatttttgtactaaactaggtaccttaaacctacctttacccccttacaaccgttttcggccgggtaacgggacccgaaagggtggaaggattcgaaagcgaaacgttgttaggctagcaccattctgttcttaac

SEQ ID NO: 367553 - DNA, 597 bp, Homo sapiens
  misc_feature: GZ8MTXP01AZFNC.19.57.F02.1.454.CMB.2.raw
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcgaacgggaaaccccctaagctcctgatctatggtgcatccacgtttgggaaagttcgggggtcccctgaaggttccaggcggcagtggaatcgtgggacagtatttcactctcgcatcagcagcctgacagactagaatattttgacttaactttagtttttagtacctaaacgtacggtaccttaaacccttaccctttccccctacttaccgtttccgggaccgggtaacggggaacccgtaaagggttggaaggtaacgttacgaaacggtacgttaaacgttggttacggtccgtcggccaccctattccgttcgttccgtttaacc

SEQ ID NO: 367554 - DNA, 535 bp, Homo sapiens
  misc_feature: GZ8MTXP01CSWL4.19.57.F02.1.454.CMB.2.raw
  modified_base (255)..(255): a, c, t, g, unknown or other
  modified_base (300)..(300): a, c, t, g, unknown or other
  modified_base (458)..(458): a, c, t, g, unknown or other
  modified_base (516)..(516): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaacgggaaaccccctaagctcctgatctatggtncatccacgtttggaaagtcgggtcccctgaaggttccaggcgcagtgaatcgtgggacagtatttcactctcgccatcagcagcctcagactagaagtatttgactaactttatttttcggactaaactaggtaccttaaacctaccctttccccctntaaccgtttcggcggaggaccaaagggtcgaagatacaagcgtaacttgttggctgcnccatcttacgtcttctaac

SEQ ID NO: 367555 - DNA, 520 bp, Homo sapiens
  misc_feature: GZ8MTXP01EHNYX.19.57.F02.1.454.CMB.2.raw
  modified_base (254)..(254): a, c, t, g, unknown or other
  modified_base (323)..(323): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaggaaaccccctaagctcctgatctatggtgcatccactttggaaagtcgggtccctnaaggttccagcgcagtggaatctgggacagatttcactctcgccatcagcagcctgcagactgaagtatttgactaactttatttttgtactaaacaggtacctaaactcctttcccctactacgtttcgggacggacgggaccaaaggtggagattcgaaagcgaacgttgttaggctgcaccattcttcgttctc

SEQ ID NO: 367556 - DNA, 581 bp, Homo sapiens
  misc_feature: GZ8MTXP01CBDFT.19.57.F02.1.454.CMB.2.raw
  modified_base (347)..(347): a, c, t, g, unknown or other
tcagtactctcgtgcacgaccggtgctcgatttagctcgatatagttgggtttggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaacccctaagctcctgatctatggtgcatccactttggaaagtggggtcccctcaaggttcagcgcaagtggntctgggacagatttcactctcgccatcagcagcctgcagactgaagtattttgactaactttatttttgtactaaactacggtactaaacctaaccttttccccctactaaccgttttcgggccgggtaacggggaacccgttaaaggggttacgggaaagtaacgttacgaaacggttccggaaaaccgttgggtacggggtcttcgggaccaacccctaattccgtttccgg

SEQ ID NO: 367557 - DNA, 610 bp, Homo sapiens
  misc_feature: GZ8MTXP01EVEAI.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcagtcaggatattaggcgctcgttaggctggtatcagcagaaagcacgggaaaccccctaagctcctgatctatggtgcatcctacgtttggaaagttcgggggtcccctgaaggttccaggcggcagtggaatcgtgggacagtattcactctcgcatcagcagcctacagactgaagtatttgacttaaactttattttcggtactaaacgtaggtacctaaacctaccctttcccccctacgttaccgttttccggggcgggtaacgggtacccgtaaaggggtcggaacggttaactacgaaaggtcccggtaaaagttcgggttacggggttccttcggacctaaccctacgttcccttacggtttcccttttcccgtaacccg

SEQ ID NO: 367558 - DNA, 583 bp, Homo sapiens
  misc_feature: GZ8MTXP01DD7RV.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcaagggaaaccccctaagctcctgatctatggtgcatccactttggaaagttcgggggtccctcgaaggttccagcggcagtgaatctgggacagatttcactctcgccatcagcagcctgacagactgaagtatttgacttaaactttatttttacgtactaaacgacggtaccttaaacctacccttttaccccctacttaaccgtttccggggaccggtaagggggaccctaaaagggttcggaaaggattaccgaaaggcggaaacgttcggttaggggcttcggaacctaaccctacgttcgttcgttccttcg

SEQ ID NO: 367559 - DNA, 596 bp, Homo sapiens
  misc_feature: GZ8MTXP01BC5FI.19.57.F02.1.454.CMB.2.raw
  modified_base (254)..(254): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcagggaaaccccctaagctcctgatctatggtgcatccacgtttggaaagttcggggtcccctcgaaggttccaggcggcagtggaatctgggacagatttcactctcgcatcagcagcctgcagactgaagatttgactaactttatttttgtactaaactaggtaccttaaacctacccttttccccctactaaccgttttccgggaccgggtaacggggaaccccaaaaggggttggaaaggaacttaccgaaaagggtccggaaaaccgttgggttacggggccttcggaaccctaaccccgaattcccttggtttccctttaacccg

SEQ ID NO: 367560 - DNA, 574 bp, Homo sapiens
  misc_feature: GZ8MTXP01A81CH.19.57.F02.1.454.CMB.2.raw
  modified_base (254)..(254): a, c, t, g, unknown or other
  modified_base (293)..(293): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcacggaacccctagctctgatctatggtncatccactttggaaagtcgggtccctgaaggttccagcggcagtggaatcgtgggacagtatttcactctcgccatcagcagcctgcagactgaagtattttgacttaactttagtttttcgtacaaaccgtaggtaccttaaacctacccttttccccctactaccgtttccggggacggtaacgggaacccgtaaagggttcgggaagtaacgttacgaaacggcggttaaacgttggttacgggctcggaacctaccctattccttcgttcctttccg

SEQ ID NO: 367561 - DNA, 572 bp, Homo sapiens
  misc_feature: GZ8MTXP01AL44P.19.57.F02.1.454.CMB.2.raw
  modified_base (195)..(195): a, c, t, g, unknown or other
  modified_base (320)..(320): a, c, t, g, unknown or other
tcagtactctcgtgcacgaccggtgctcgatttagctcgatatagttgggtttggggagtcagacccagtcaggacacagcatggacatgagggtcccgctcagctcctggggctcctgctgctctggttcccaggttccagatgcgacatccagatgacccagtctccatcttccgtgtctgcatctgtagganacagagtcaccatcacttgtcgggcagtcaggatattaggcgctcgttaggctggtatcagcagaaagcagggaacccctaagctcctgatctatggtgcatccactttggaaagtgggtccctnaaggttcagcgcagtggaatctgggacagatttcactctcgccatcagcagcctgcagactgaagattttgctaaactttattttagtctaaactaggtactaaacgactttaccccctctaaccgttttccgggaccggaacggggtacccctaaaggggtggaacggtattaccgaaacggtaccggaaaccgttggttacggggccttgggccctaacccgtacttcccttggttaacccgttttcccg

SEQ ID NO: 367562 - DNA, 619 bp, Homo sapiens
  misc_feature: GZ8MTXP01C0XML.19.57.F02.1.454.CMB.2.raw
  modified_base (336)..(336): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatattaggcgctcgttaggctggtatcagcagaaagcaagggaacccctaagctcctgatctatggtgcatccatttggaaagtggggtcccctcaggttacngcggcaagtggaatcgtggggacagatttcactctcgcatcagcagcctgcagactgaagtattttcgacgttaaacttttatttttagtacctaaacgtacggtaccttaaaccgttacccttttaccccccttcgtaaaccgttttccggggaccggggtaaacggggtaaccccgttaaagggggttacgggaaggtaaacgttccgaaaaacgggccggttaaaacccgttgggtacggggtcccttacgggaccaaccccgttaagttccgtttccgg

SEQ ID NO: 367563 - DNA, 601 bp, Homo sapiens
  misc_feature: GZ8MTXP01ERKLH.19.57.F02.1.454.CMB.2.raw
  modified_base (255)..(255): a, c, t, g, unknown or other
  modified_base (396)..(396): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtancagcagaaagcaagggaaaccccctagctcctgatctatggtgcatccactttggaaagtcgggtccctgaaggttccaggcggcagtggaatcgtgggacagtatttcactctcgcatcagcagcctgcagactgaagtntttgactaactttagtttttgtactaaactacggtaccttaaacctaccttttccccctacgttaccgtttccggggacgggtaacggggaaccctaaaggggttcggaaagggtacttacgaaacggtccggttaaaacgttcggttacggggccttacgggaacccgtaaccccgtattaccgttcggtttccttttaacccg

SEQ ID NO: 367564 - DNA, 544 bp, Homo sapiens
  misc_feature: GZ8MTXP01B3HOJ.19.57.F02.1.454.CMB.2.raw
  modified_base (326)..(326): a, c, t, g, unknown or other
  modified_base (349)..(349): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggttggtatcagcagaaagcagggaaaccccctaagctcctgatctatggtgcatccactttggaaagtggggtcccctnaaggttcagcggcagtggatcgngggcagatttcactctcgcatcagcagcctgcagactgaagtatttgactaactttattttggtacaaactaggtacttaaacctacctttccccctctacgttttccgggcgggtaacgggtacccaagggttggaagatcgaaaggcgtaacgttgttcgggctggaccaactatcttcgttccttcgtaacc

SEQ ID NO: 367565 - DNA, 612 bp, Homo sapiens
  misc_feature: GZ8MTXP01BND5P.19.57.F02.1.454.CMB.2.raw
  modified_base (377)..(377): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattagggcgctcgttaggctggtatcagcagaaagcgaacgggaaaccccctaagctcctgatctatggtgcatcctacgtttggaaagttcggggtcccctcgaaggttccagcggcagtggaatcgtgggacagtattcactcncgcatcagcagcctgacagactagaagtattttgacttaaacttttattttcgtactaaacgtacggtaccttaaacctacccttttaccccctacgtaccgtttccgggacgggtaacgggtaacccgtaaaggggttcgggaagtaacgttacgaaacggtccgttaaacgttgggttacggggaaccttagggccctaacccgtaattccgttaacgttcccgttttaaccg

SEQ ID NO: 367566 - DNA, 529 bp, Homo sapiens
  misc_feature: GZ8MTXP01BMV16.19.57.F02.1.454.CMB.2.raw
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcacgggaaaccccctaagctcctgatctatggtgcatccactttggaaagtcggggtcccctgaaggttccaggcggcagtggaatcgtgggacagatttcactctcgccatcagcagcctgacagactgaagtatttgactaactttatttttgtactaactacggtactaacctacctttccccctactaccgtttcggcggtacgggaccaaggtggagtattacgaagtcgaacgttgttggctgcacattctgttcttc

SEQ ID NO: 367567 - DNA, 552 bp, Homo sapiens
  misc_feature: GZ8MTXP01ALC14.19.57.F02.1.454.CMB.2.raw
  modified_base (253)..(253): a, c, t, g, unknown or other
tcagtactctcgtgcacgaccggtgctcgatttagctcgatatagttgggtttggggagtcagacccagtcaggacacagcatggacatgagggtcccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcagggaaaccccctaagctcctgatctatggtgcatccatttggaaagtcggggtccctgaaggttccaggcggcagtggaatcgtgggacagatttcactctcgcatcagcagcctgcagactgaagtatttgacttaactttatttttgactaactacggtactaactacctttcccctactacgtttccgggacggtaacgggtacccgaaagggttggaaggtacttacgaaacggcgttaacgttggttcggaacttgaaccaccattcttcgttctttaaccg

SEQ ID NO: 367568 - DNA, 510 bp, Homo sapiens
  misc_feature: GZ8MTXP01DE1QO.19.57.F02.1.454.CMB.2.raw
  modified_base (448)..(448): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaaggatattaggcgctcgttaggctggtatcagcagaaagcagggaaaccccctaagctcctgatctatggtgcatccactttggaaagtggggtcccctcaaggttcagcggcaagtggaatctggggacagtatttcactctcgcatcagcagcctgcagactgaagtattttgacttaactttattttgactaacagctaacacctttcccctntacttcggcggtaagggaccaagggtgagtatcaagcgaactgtggctgcacctaattctcg

SEQ ID NO: 367569 - DNA, 597 bp, Homo sapiens
  misc_feature: GZ8MTXP01AQ1F4.19.57.F02.1.454.CMB.2.raw
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaacgggaaaccccctaagctcctgatctatggtgcatccctaacgtttgggaaaggttcggggtcccctgaacggttccaggcggcaggtggaatcgtgggacagtatttcactctcgcccatcagcagcctgcagactgaagtattttgacttaaactttagtttttacgtacctaaacgtacgggtacccttaaacctaccccttttccccccgtacttaaccgtttccgggacggggtaacgggacccgaaaggggttgggaacggtattacgaaacggccgaaacgttggttcgggcctggccaaccctcttccgttcgttcctaac

SEQ ID NO: 367570 - DNA, 575 bp, Homo sapiens
  misc_feature: GZ8MTXP01DL7D2.19.57.F02.1.454.CMB.2.raw
  modified_base (374)..(374): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggttggtatcagcagaagacacgggaaaccccctaagctcctgatctatggtgcatcctacgtttggaaagttcgggggtcccctacgaaggttcacgcggcaggtgatcgagggcagtatttcactcncgcatcagcacgcctgcaagactagaagttatttgacttaactttatttttagggactaaacgtaacggtaccttaaacctacccctttcccccttcgtaaccgtttaccgggcgggtaacgggaccgtaagggtaaggtagacgtacgaacgcgaacgttcggttcggcgtgacctaactactcttcgttcttaacgtcc

SEQ ID NO: 367571 - DNA, 636 bp, Homo sapiens
  misc_feature: GZ8MTXP01CAEQ5.19.57.F02.1.454.CMB.2.raw
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcaagaaagcgaacgggaaaccccctaagcctcctgatctagtggtgctactcctaagtttagggaaacggttcggggtcccctagtaacggttccaggcggcgaggtggaatcgtgggactagtactttcactctcgccatcagcacgcctgacagtacgtagtaagttatttacgacttaactttttagttttacgaacctaaacgtacggtaaccttaacccttacccctttaccccgtacgttaccggtttccggggacggggtaaccgggtaaccggtaaaggggttgggaagtaacgttacgaaacggtcggttaaacgttcgggttacggtcgtacggaacctaaccctgttccgttcggttcctttaaccg

SEQ ID NO: 367572 - DNA, 611 bp, Homo sapiens
  misc_feature: GZ8MTXP01EOWFZ.19.57.F02.1.454.CMB.2.raw
  modified_base (222)..(222): a, c, t, g, unknown or other
  modified_base (255)..(255): a, c, t, g, unknown or other
  modified_base (295)..(295): a, c, t, g, unknown or other
  modified_base (392)..(392): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggnagtcaggatattaggcgctcgttaggctggtancagcagaaagcaggaaccccctagctcctgatctatggtncatccatttggaaagtcgggtccctgaaggttccagcggcagtggaatcgtgggacagtatttcactctcgccatcagcagcctgcagactgaagtntttgacttaaactttagtttttagactaaacgaggtaccttaaacctacccttttccccctacgttaccgttttaccggggacgggtaacggggtaacccgaaaggggttcggaacggtaacttaccggaaaacggtccggttaaaaccgttgggttacggggaacccttcgggaacccgtaaccccttagttacctttcgggtttcccttttaacccg

SEQ ID NO: 367573 - DNA, 593 bp, Homo sapiens
  misc_feature: GZ8MTXP01AHX88.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatattaggcgctcgttaggctggtatcagcaagaaagcaacgggaaaccccctaagctcctgatctatggtgcatccacgtttagggaaagttcggggtcccctagaaggttccaggcggcagtggaatcgtgggacagtatttcactctcgcatcagcagcctgacagactagaagttatttagacttaactttagtttttacgactaaacgacggtaccttaaacctccctttccccctacgtaccgtttcggggaccggtaacggggacccgtaaagggtcggaagtacttacgaaacggtccgttaaacgttgggttacggtcgttcggaacctaccgtattccgttcgttcctttccg

SEQ ID NO: 367574 - DNA, 586 bp, Homo sapiens
  misc_feature: GZ8MTXP01DMH7I.19.57.F02.1.454.CMB.2.raw
  modified_base (254)..(254): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttgtcgggcagtcaggatattaggcgctcgttaggctggtancagcagaaagcaacgggaaaccccctaagctcctgatctagtggtgctatccctagtttagggaaagttcgggggtcccctacgaaggttccaggcggcagtggaatcgtgggactagtatttcactctcgcatcagcagcctgcagactagaagtatttgacttaactttagtttttcgtactaaacgtacggtaccttaaacctaccctttaccccctactaccgtttccgggacgggtaacgggaccgtaaagggtgaagtacttacgaaacggcgttaaacgttggttacgggtcctaggcctaccgtacttccgtcgttccttaacc

SEQ ID NO: 367575 - DNA, 526 bp, Homo sapiens
  misc_feature: GZ8MTXP01D1TNY.19.57.F02.1.454.CMB.2.raw
  modified_base (254)..(254): a, c, t, g, unknown or other
  modified_base (326)..(326): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtancagcagaaagcagggaaaccccctagctcctgatctatggtgcatcctactttggaaagttggggtcccctnaaggttccagcggcagtggaatctgggacagatttcactctcgccatcagcagcctgcagactgaagtatttgactaactttatttttgtactaaactaggtacctaaacctacctttccccctactaccgtttcgggacggagggtccaaagggtgagattcgaaagcgaacgttgttaggctgcacattctgttcttc

SEQ ID NO: 367576 - DNA, 541 bp, Homo sapiens
  misc_feature: GZ8MTXP01CM2TP.19.57.F02.1.454.CMB.2.raw
  modified_base (459)..(459): a, c, t, g, unknown or other
tcagtactctcgtgcacgaccggtgctcgatttagctcgatatagttgggtttggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggtatcagcagaaagcaagggaaaccccctagctcctgatctatggtgcatccatttaggaaagtcggggtcccctcaaggttcagcgcaagtgaatcgtgggacagatttcactctcgcatcagcagcctgcagacttgaaagtacttttagacgtaaacttttatttttgactaaacacggtacttaaacctacctttccccctntaccgtttcggcgggaagggtaccgaagggtgagtaactcgaaaggcgaaacttggacggtctcggccacctaagttcttcg

SEQ ID NO: 367577 - DNA, 619 bp, Homo sapiens
  misc_feature: GZ8MTXP01DPK59.19.57.F02.1.454.CMB.2.raw
  modified_base (312)..(312): a, c, t, g, unknown or other
  modified_base (408)..(408): a, c, t, g, unknown or other
  modified_base (430)..(430): a, c, t, g, unknown or other
  modified_base (449)..(449): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggtatagttaggcgtctcggttaggctggtatcagcaagaaagcgaacgggaaaccccctaagctctgatctagtggtnctatcctacgtttaggaaacggtcggggtacccctcgaaggttcagtcggcgaaggtggaagtcgtaggggactagtactttcactctcgcatcancagcctgacagactagaagttntttagacgttaaacttttnttttacgactaaacgacgtaccttaacctacccttttcccctagtaccgtttcggggacggaaacgggtaccgttaaagggtcggttaaacgtaagtacccgaaagggttaccttaaacggttcgggtacggtaaccttacggtcccaaaccgtaacgtttcgtttcccg

SEQ ID NO: 367578 - DNA, 566 bp, Homo sapiens
  misc_feature: GZ8MTXP01CXY5K.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatattagggcgctcgttaggctggtatcagcagaaagcaacgggaaaccccctaagctcctgatctatggtgcatcctacgtttggaaagtcgggtcccctcgaaggttccaggcgcgagtggaatcgtgggacagtatttcactctcgccatcagcagcctgcagactagaagtattttgacttaacttttatttttacgtactaaactacggtacttaacctacctttcccccgtactaccgtttcgggacgggtacgggtaccgaaagggtggaagtacgttacgaaaggtcgaacgttcggttaggcctgcctaccgattcttcgttctttcc

SEQ ID NO: 367579 - DNA, 624 bp, Homo sapiens
  misc_feature: GZ8MTXP01BZ7TS.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatagttaggcgctcgttaggctggtatcagcaagaaagcgaacgggaaaccccctaagctcctgactctatggtgcatcctactttgggaaagtcgggggtcccctcgaaggttccaggcggcagtggaatcgtgggacagtattcactctcgcatcagcagcctgacagactagaagtatttagacttaacttttagtttttcgtactaaactacggtaccttaaacctaccctttaccccctacgttaccgttttaccggggaccgggtaacggggtaacccgtaaaggggttacgggaacggtaacttaccgaaacgggtaccgttaaaccgttgggttacgggtccttacggaaccctaacccgtattccgttggtttcccgttttaaccg

SEQ ID NO: 367580 - DNA, 558 bp, Homo sapiens
  misc_feature: GZ8MTXP01CNB1S.19.57.F02.1.454.CMB.2.raw
  modified_base (465)..(465): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggtatattaggcgctcggttaggctggtatcagcagaaagcgaacgggaaaccccctaagctcctgatctatggtgcatccagtttggaaacgtcggggtcccctcgaaggttcaggcggcgaagtggaatcgtgggacagtattcactctcgcatcagcagcctgcagactgaagtatttgactaattttattttagactaaacgtagtaccttaacctaccctttccccctntaccgtttcgggcggtaacgggtaaccaggggtggagtaacgtcgaaacgcgttaacgtggtacgggctcggaccttacctaagttcgttccg

SEQ ID NO: 367581 - DNA, 569 bp, Homo sapiens
  misc_feature: GZ8MTXP01AYUJC.19.57.F02.1.454.CMB.2.raw
  modified_base (254)..(254): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtancagcagaaagcagggaaaccccctaagctcctgatctatggtgcatcccacgttttagggaaagttcgggggtccccctagaacgggttcccaggcggcaggtggaactcgtgggacagtatttcactcgtcgcatcagcagcctgacagactgaagtatttgacttaatttatttttgactaacaggtaccttaaacctacctttccccctactaccgttttccggggaccgggtaacggggaacccgaaagggttgggaacgtacttacgaaacggtcgaacgttggttacggctgcaccattctcgttcttc

SEQ ID NO: 367582 - DNA, 567 bp, Homo sapiens
  misc_feature: GZ8MTXP01BJUD7.19.57.F02.1.454.CMB.2.raw
  modified_base (254)..(254): a, c, t, g, unknown or other
  modified_base (399)..(399): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcagggaaccccctagctcctgatctatggtgcatccactttggaaagttcgggggtcccctgaaggttccaggcggcagtggaatcgtgggacagtatttcactctcgccatcagcagcctgacagactgaagtntttgactaactttagttttcgactaacgtacggtaccttaacctacccttttcccctacgtaccgttttccgggcgggtaacggggaacccaaggggttcggaaggacgttcgaaacggcgttaaacgttggttacgggctggccaccgtattccgtgttcctttccg

SEQ ID NO: 367583 - DNA, 594 bp, Homo sapiens
  misc_feature: GZ8MTXP01EE5LJ.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgctcgttaggctggtatcagcagaaagcaagggaaaccccctaagctcctgatctatggtgcatcctacgtttaggaaagttcgggggtcccctagaaggttccaggcggcgagtggaatcgtgggacagtatttcactctcgccatcagcagcctggacagtactaggaatattttgacttaaactttagtttttggtactaaacgtacggtacttaaccctaacccttttccccctacgtaccgttttcgggaccgggtacgggtaacccgaagggttggaaggtattacgaaaggtcgttaaacgttgggttacgggcttcggcctaacccttgttaccttcgttcttcg

SEQ ID NO: 367584 - DNA, 559 bp, Homo sapiens
  misc_feature: GZ8MTXP01D3CKK.19.57.F02.1.454.CMB.2.raw
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattagggcgctcgttaggctggtancagcagaaagcaacgggaaaccccctaagctcctgatctatggtgcatcctacgtttaggaaagtcggggtaccctcgaaggttccaggcggcaggtggaatcgtggggactaggtactttcactctcgccatcagcagcctgacagactgaagtatttgacttaactttattttcgtactaacgtacggtacctaaacctaccctttcccctactaccgtttcgggacggtacggaccgtaagggtggaagtattacgaaagtcgaacgttggttacggctgcacgtattctcgttcttaac

SEQ ID NO: 367585 - DNA, 622 bp, Homo sapiens
  misc_feature: GZ8MTXP01AV66M.19.57.F02.1.454.CMB.2.raw
  modified_base (254)..(254): a, c, t, g, unknown or other
  modified_base (295)..(295): a, c, t, g, unknown or other
  modified_base (323)..(323): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaacgcaggaaacccctaagctctgatctatggtncatccacgtttggaaagtcgggtccctnaagttcagcggcagtggaatcgtgggacagattcactctcgccatcagcagcctgccagactgaagtattttcgacttaaactttagtttttagtacctaaacgacggtaccttaaaccttacccttttaccccctactacccggtttttaccgggaccgggtaaccggggtaacccgtaaaggggttcgggaaaggtaacttacggaaacgggtaccgttaaaaccgttggggttacgggtaaccttacgggaacccgtaaccccgtaattacccggttaacgttcccttttaacccg

SEQ ID NO: 367586 - DNA, 571 bp, Homo sapiens
  misc_feature: GZ8MTXP01BON10.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatattaggcgctcgttaggctggtatcagcagaaagcaacgggaaaccccctaagctcctgatctatggtgcatccatttggaaagttcggggtcccctgaggttccaggcggcaggtggaatcgtgggacagatttcactctcgccatcagcagcctcagactgaagtatttgactaatttattttggtactaaacgtacggtaccttaaacctacccttttccccctctaaccgtttcgggccgggtaacgggtacccgtaagggtggaacgacttacgaaagccgtaaacgttggttggccttggaccaacctactcgttcgttccgtttcgtaaccg

SEQ ID NO: 367587 - DNA, 672 bp, Homo sapiens
  misc_feature: GZ8MTXP01D281N.19.57.F02.1.454.CMB.2.raw
  modified_base (261)..(261): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcaggattagttaggcgctcggttaggctggtancagacaagaaagcgaacgggaaaccccctaagcctcctgatctagtggtgcatccctacgtttagggaaacggttcgggggtaccccctagtaacggttccgaaggcggacgtaggtaggtaacttcgtaagggggaacctaaggtacttttccaaccgttccgtccgacccatccgagccgacgcccgtagaccagtaacgtaggtaaagttagtttacgaactttaacgttttagttttacgaacctaaacgtacggtacccttaaacccttaccccttttcccccgtacgttaccggtttcgggtacgggaacgggtaacccgtaagggttacggaagtacgttacgaaacggtacccgttaagttggttacggtctcgaacctacctattccttcgttccttaaccg

SEQ ID NO: 367588 - DNA, 632 bp, Homo sapiens
  misc_feature: GZ8MTXP01CISMZ.19.57.F02.1.454.CMB.2.raw
  modified_base (266)..(266): a, c, t, g, unknown or other
  modified_base (428)..(428): a, c, t, g, unknown or other
  modified_base (463)..(463): a, c, t, g, unknown or other
  modified_base (593)..(593): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccattcttccgtgtctgcatctgtaggagacagagtcacatcacgttggcgggcagtcaaggtattagttagggcgtcgtcggttaggcgtggtancgagacaagaaacgaccgaaacgggaaaccccctaagcctacctgactcgtagtcggtgactatccgtagtttagggaaacggttcgggggtaccccctagtaacggttcccgaggcggacgtaggtggaacgttcggtgggaactagtactttcgacttcncgcatcagcacgcctgacagtactagtaaacgttntttacgactttaactttagttttagaacctaacgtacggtaccttaaccttaccctttccccgtactaccggttcgggaccgggtaacggaaccgtaagggtaggagacgttacgaaacggcgttaacgngggttacgctacgcctactattccttcgttctttaaccg

SEQ ID NO: 367589 - DNA, 610 bp, Homo sapiens
  misc_feature: GZ8MTXP01A7GIM.19.57.F02.1.454.CMB.2.raw
  modified_base (331)..(331): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcacgggaaaccccctaagctcctgatctatggtgcatccacgtttgggaaacgtcggggtcccctnaaggttccagcggcagtggaatctgggacagatttcactctcgcatcagcagcctgcagactgaagtatttgcttaactttattttcgtactaaacaggtaccttaaacctaccttttaccccctactaaccgttttccggggaccgggaacggggtaaccccgaaaggggttcggaaagggtacttacccgaaaaggccggttaaaaccgtttgggacggggtcccttacgggtaacccgaaaccccgttacgttacccgtttcgtttcccgtttccg

SEQ ID NO: 367590 - DNA, 609 bp, Homo sapiens
  misc_feature: GZ8MTXP01DCSCJ.19.57.F02.1.454.CMB.2.raw
  modified_base (255)..(255): a, c, t, g, unknown or other
  modified_base (388)..(388): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaacgggaaaccccctaagctcctgatctatggtgcatcctacgttggaaagttcggggtcccctgaacggttccaggcggcgaggtggaatcgtgggactagtatttcactctcgccatcancagcctgacagactagaagtatttgacttaacttttattttacgactaaacgtacggtaccttaaaccttaccctttaccccctacgttaaccgttttccggggacgggtaacggggtaaccctaaaggggttcgggaaacgtaacgttaccgaaagggtccgggttaacgttgggttacgggccttaggcctaacctattccgttcgttccgtttaaccg

SEQ ID NO: 367591 - DNA, 594 bp, Homo sapiens
  misc_feature: GZ8MTXP01BQZ5M.19.57.F02.1.454.CMB.2.raw
  modified_base (396)..(396): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcaggatagttagggcgcgtcggttaggctggtatcagcaagaaagcgaacggaaaccccctaagctcctgatctatggtgctatcccgtacgtttagggaaacggttcgggtccccctagtaacggttccaggcggcgagtggaactcgtgggactagtattcactcncgccatcagcacggcctgacagacgtagaagttactttagactttaacgttttgttttacgtactaacgtacgtacctaacccttccctttcccctacgtaccgtttcgggacggtaacgggccgtaaggtgaagacgttacgaacggtcgaacgttggttacggtcctaggccaacctgttcctcgttcttaacccg

SEQ ID NO: 367592 - DNA, 578 bp, Homo sapiens
  misc_feature: GZ8MTXP01C012I.19.57.F02.1.454.CMB.2.raw
  modified_base (355)..(355): a, c, t, g, unknown or other
  modified_base (402)..(402): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcggcgagtcaggatattaggcgctcgttaggctggtatcagcaagaaagacaacgggaaacccctaagctcctgatctatggtgcatcctacgttggaaagtgggtccctcgaaggttcagcggcagtgaatcgtggganagatttcactctcgccagtcagcacgcctagaccagtactgaaagtnttttagacttaaactttattttgtacaaacgtacggacttaacctaccctttacccctacgtacgtttcgggaccggtaacgggaacccgaaagggttcggaacgagttccgaaaagcgttaaaccgttggttcgggaaccttggaaccgaaccctagttcttcggttctttaacc

SEQ ID NO: 367593 - DNA, 528 bp, Homo sapiens
  misc_feature: GZ8MTXP01DHKAF.19.57.F02.1.454.CMB.2.raw
  modified_base (256)..(256): a, c, t, g, unknown or other
  modified_base (347)..(347): a, c, t, g, unknown or other
  modified_base (394)..(394): a, c, t, g, unknown or other
  modified_base (396)..(396): a, c, t, g, unknown or other
  modified_base (398)..(398): a, c, t, g, unknown or other
  modified_base (491)..(491): a, c, t, g, unknown or other
  modified_base (504)..(504): a, c, t, g, unknown or other
  modified_base (510)..(510): a, c, t, g, unknown or other
  modified_base (512)..(512): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccattcttccgtgtctgcatctgtaggagacagatcaccatcacttgtcgggcagtcaggatattaggcgctcggttaggctggtancagcagaaagcgaacgggaaaccccctaagctcctgatctatggtgcatcctaacgtttgggaaagtcggggtcccctgaacggttcaggngcagtggaatcgtgggacagtatttcactctacgcccatcacgcacncnanagatagaatattatacttaatttagtttatactaacacgtactaaccttaccttaccctacctacgtcggtacggacggaacgaagtagaganagaacgacgacgngttcgncncactcttctcgttctc

SEQ ID NO: 367594 - DNA, 788 bp, Homo sapiens
  misc_feature: GZ8MTXP01CCTKD.19.57.F02.1.454.CMB.2.raw
  modified_base (257)..(257): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagcctccatcttccgtgtctgacatctgtaaggagacagagtcaccatcacttggcgggcagtcaggatagttaggcgctcgttaggctggtancagcagaaagcaacgggaaaccccctaagctcctagatcgtatggtgacatccaacgttttagggaaacgtcgggggtacccccttagaaacggtttccccgaaggcgggacgtaaggtagggtaaacgttacccgttaagggggaaacctaagggttaaactttttcccgaaaccgttttccctaccgggacccctaaagttcccaaagggcccttaacggcccttacgtaccgaacgaacgtagtaaacggttaacgttttagttacgttaaaccgttttaagtttttacggtttaactaaaccgtaaacgggtaaccgttaaacccgttaaccctttaccccctttacccgttaacccgtttacccggggttaccggggtaaaccggggtaaacccgggaaacggggttaacgggttaaacggtaaacggttaacgtaaaggtaaccggaaacccggttaacggttagggtaaccggtccggtaaccgtacccgaaacgttaccgttaaccgttccgttttaaccccg

SEQ ID NO: 367595 - DNA, 681 bp, Homo sapiens
  misc_feature: GZ8MTXP01EB0WL.19.57.F02.1.454.CMB.2.raw
  modified_base (258)..(258): a, c, t, g, unknown or other
  modified_base (307)..(307): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatagttaggcgctcggttaggctggtancgagcaagaaagcgaaacggaaacccctagcctcctagatctagtggtnactactacccgtagtttagggaaacggttccggggtacccctacgtaacggttccacggtcggacgtaggtcggaaacttcggtaaggggaacctaaggttacttttaccaaccgttcgtaccgaccctataccgaacggcacggtcctaggaccgtagtacgtagtaaagtttactttacgtaactttaacgttttattttacggtaactaaacgtacgtaaccttaacccttacccctttaccccgttacgttaccggtttccggggaacgggtaaccgggtaaacccggtaaagggttaggaacgtacgttaacggaaacgtacgttaacgttggttacgcgtcgtaacacctagttctcgtttcttaacc

SEQ ID NO: 367596 - DNA, 550 bp, Homo sapiens
  misc_feature: GZ8MTXP01DVH16.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacatcacttgcgggcagtcaggatagttaggcgctcgttaggctggtatcagcagaaagcaagggaaaccccctaagctcctgatctatggtgcatcctatttggaaagttcgggtccctgaaggttccagcggcagtgaatcgtgggacagtatttcactctcgcatcagcagcctgacagactgaagtatttgactaactttattttgactaaacgacggtactaaacctccttttccccctacgtacgtttcgggacgggtaacgggaccctaaagggttggaacgagttacgaaacggtcgaaacgttggttggctaggctaccattcttgttctttaacc

SEQ ID NO: 367597 - DNA, 571 bp, Homo sapiens
  misc_feature: GZ8MTXP01ATX0S.19.57.F02.1.454.CMB.2.raw
  modified_base (255)..(255): a, c, t, g, unknown or other
  modified_base (373)..(373): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaaggaaccccctaagctcctgatctatggtgcatcctacgtttggaaagtcgggggtcccctgaaggttccaggcggcagtggaatcgtgggacagtatttcactcncgccatcagcacgcctgaccagtactgaagtattttgacttaactttattttgactaactacggtaccttaacctaccctttcccctacgtaccgtttccggggacgggtacggggaacccgtaaaggggtggaacgacgttaccgaaaggccggttaacgttgggttaggtccgtggccacctcttcgtcgttctcg

SEQ ID NO: 367598 - DNA, 590 bp, Homo sapiens
  misc_feature: GZ8MTXP01BILFD.19.57.F02.1.454.CMB.2.raw
  modified_base (197)..(197): a, c, t, g, unknown or other
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatagttaggcgctcgttaggctggtancagcagaaagcaacgggaacccctagctcctgatctagtggtgcatccctaagtttagggaaagttcgggggtaccccctagaacggttccaggcggcagtggaatcgtgggacagtatttcactctcgaccatcagcagcctgcagactagaagtatttgacttaactttagttttagtactaactaggtacctaaaccctacctttccccctacgtaccgtttccgggacgggtacggggtacccgaaaggggttacggagtacgttacgaaacggtacgaacgttggttcggccgtacggccgaaccctattccttcgttcccgttaaccg

SEQ ID NO: 367599 - DNA, 626 bp, Homo sapiens
  misc_feature: GZ8MTXP01DP1SD.19.57.F02.1.454.CMB.2.raw
  modified_base (197)..(197): a, c, t, g, unknown or other
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattagggcgctcgttaggctggtancagcagaaaagcaacgggaaaccccctaagctcctgatctagtggtgcatcctactttggaaagtcgggtccctgaaggttccagcggcagtggaatcgtggggactagatttcactctcgccatcagcagcctgacagtactgaaagtattttgacttaactttagtttttacgtactaaactacggtacttaaacctacccttttaccccctacttaccgttttccggggaccgggtaacggggaacccgtaaaggggttgggaaacgtaacgttaccgaaacgggtaccgttaaaccggttgttacggggtaaccttcgggaacccgtaaccccgtaagtttccctttcggtttccgttttaacccg

SEQ ID NO: 367600 - DNA, 573 bp, Homo sapiens
  misc_feature: GZ8MTXP01BGEGX.19.57.F02.1.454.CMB.2.raw
  modified_base (257)..(257): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggattattaggcgctcgttaggctggtancagcagaaagcacgggaaaccccctagctcctgatctatggtgctatcctacgtttaggaaacggttcggggtacccctagaacggttccaggtcggacagtggaatcgtgggacagtatttcactctcgccatcaggcacgcctgacagactagtaaagttatttgacttaaacttttagttttgtactaacgtacggtaccttaaacctccctttacccctacgttaccgtttccgggacggtacgggacctaagggtggaagtattacgaagcgagttcggttcggtctgccactagttctcgttcttaaccg

SEQ ID NO: 367601 - DNA, 639 bp, Homo sapiens
  misc_feature: GZ8MTXP01A870D.19.57.F02.1.454.CMB.2.raw
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatattaggcgctcgttaggctggtancagcagaaagcgaacgggaaaccccctagctctgatctatggtgcatccacgtttagggaaacgttcggggtacccctgaaggttccaggcggcagtggaatcgtggacagtatttcgactctcgaccatcagcagcctagcagactagaagttactttgacttaaacttttagtttttcgactaaactaggtaccttaaacccttaccccttttacccccgttcgtaaacccggttttccggggaccggggtaaacgggggtacccgtaaaggggttacgggaaggaaacgttaccggaaaacggtcccggaaacgtttggggttcgggaactttcggaacccctaacccggttattcctttaacggtttccgtttaacccg

SEQ ID NO: 367602 - DNA, 579 bp, Homo sapiens
  misc_feature: GZ8MTXP01BP4DS.19.57.F02.1.454.CMB.2.raw
  modified_base (222)..(222): a, c, t, g, unknown or other
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgatcagctcctggggctcctgctgctctggttcccaggttccagatgcgacatccagatgacccagtctccatcttccgtgtctgcatctgtaggagacagagtcaccatcacttgtcgggnagtcaggatattaggcgctcgttaggctggtancagcagaaagcaagggaaaccccctagctcctgatctatggtgcatccatttggaaagtcgggtccctgaggttccaggcggcagtggaatcgtgggactaggatttcacttctcgccatcagcagcctgacagactagaagtatttgacttaactttattttagtacaaacgtaggtaccttaaacctaccttttcccctactaaccgttttcggggaccggttaagggaacccgtaaaggggttggaaggtacttacgaaacggacggttaaaccgttggttacgggcttggcctacgtacttccgttcgttcctttaaccg

SEQ ID NO: 367603 - DNA, 873 bp, Homo sapiens
  misc_feature: GZ8MTXP01DZWXX.19.57.F02.1.454.CMB.2.raw
  modified_base (259)..(259): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgctcggttaggctggtancagcaagaaagccgaaacgggaaacccccctaagcctaccgtagacttcgtaagttggtacgacctaacgttcccgtaaaacggtttttacgggggaaaaacggtttccggggggttaacccccctacggtaaaacggggtttccccgaacgggtacggggaccggtaagggttacgggtaaaacgttccgggtaagggggtaaacctaaagggttaccttttttacccgaacccttccgttacccggaccctaacgttccaaacgggccaacggtccccgttaggaacccgtaaaggtaaccgttacggttaaaacgttaagttttttacggtaaaccttttaaaccgttttttaagttttttttaacggtaaccttaaaacccggttaacgggttaaacccctttaaaaaccccgttccccttttttaacccccccgttaccgtttaacccggttttacccgggggaaccgggtaaaccgggggtaacccgtaaaagggggttaagggaaacgtaaaccgttaacgtaaaacgggtaccgttaaaaccggtttggttacgggttcctacggaaccctacccgtactttccggttccgtttccgtttaacccg

SEQ ID NO: 367604 - DNA, 616 bp, Homo sapiens
  misc_feature: GZ8MTXP01AK71R.19.57.F02.1.454.CMB.2.raw
  modified_base (254)..(254): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaggaaacccctaagctcctgatctatggtgcatccactttggaaagtcgggggtcccctgaaggttcccaggcggcagtggaatcgtgggacagatttcactctcgccatcagcagcctgcagactgaagtattttgacttaactttatttttagtactaaacgtaacggtaccttaaacctaccttttcccccctacgtaaccgttttccggggaccggggtaacggggtaacccgaaaaggggttcgggaacggtaaattcccgtaaaagggtccggaaaaccgttgggttacggggcccttgggaacccgtaaccccgtaagttacccttggtttcccttttaacccg

SEQ ID NO: 367605 - DNA, 580 bp, Homo sapiens
  misc_feature: GZ8MTXP01A53EK.19.57.F02.1.454.CMB.2.raw
  modified_base (302)..(302): a, c, t, g, unknown or other
  modified_base (420)..(420): a, c, t, g, unknown or other
  modified_base (567)..(567): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatagttaggcgctcggttaggctggtatcagcaagaaagcgaacgggaaaccccctagctcctgatctatggtnctatccgagtttagggaaacgttcggggtacccctagaaggttccgaggcggcaggtggaatcgtgggactagtatttccactctcgccatcagcacgcctgacagactagtaagttntttagacttaactttagttttcgactaactacgtaccttaacctccctttcccctacgtaccgtttccgggacgggtacgggaccgtaaagggtcggaagtacttacggaaagtcgttaacgttggttacggtctcggcctaacctnttcttcgttcctc

SEQ ID NO: 367606 - DNA, 601 bp, Homo sapiens
  misc_feature: GZ8MTXP01C6WI2.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatagttaggcgctcgttaggctggtatcagcagaaagcgaacgggaaaccccctaagcctcctgatctatggtgcatcctacgtttgggaaagttcggggtacccctgaacggttccaggcggcagtggaatcgtgggacagtatttcactctcgcatcagcagcctgacagactagaagtatttgacttaactttagttttacgactaaacgtacggtaccttaaacctaccctttcccctactaccgttttccgggacgggtaacggggaaccgtaaaggggttcggaaacggtacgttacgaaagggtccgttaaaggttcggttacgggccttaggcctaccgtactttccgttgttaacccgtttcc

SEQ ID NO: 367607 - DNA, 598 bp, Homo sapiens
  misc_feature: GZ8MTXP01BZRXJ.19.57.F02.1.454.CMB.2.raw
  modified_base (257)..(257): a, c, t, g, unknown or other
  modified_base (587)..(587): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatagttaggcgctcgttaggctggtancagcagaaagcaacgggaaacccctaagctcctgatctatggtcgctactaccctacgttttagggaaaacggttcgggggtacccccttcgtaaacggtttcccaaggcggtcgaggtggaaatcgtgggacagtatttcgactctcgccatcagcacgccgtgacaggactagtaaagtatttcgactaaacttttagttttacgtacaaactacggtaccttaacctacctttcccctactaccgtttcgggaccggtacgggtaaccgtaagggtcgaaggacttacgaaaggcgttaaacgttggttcgaactggaactaacctnttctcgttctc

SEQ ID NO: 367608 - DNA, 603 bp, Homo sapiens
  misc_feature: GZ8MTXP01AMGMT.19.57.F02.1.454.CMB.2.raw
  modified_base (310)..(310): a, c, t, g, unknown or other
tcagtactctcgtgcacgaccggtgctcgatttagctcgatatagttgggtttggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggatagttaggcgtctcgttaggctggtatcagcaagaaagcgaacgggaaaccccctaagcctcctgatctatggtncatccacgtttgggaaacgtcggggtcccctacgaaggttcaggcggcgaaaggtggaatcgtggggacagtatttcactctcgcatcagcagcctgcagactagaagtattttgacttaacgtttattttacgactaaacgtacggtaccttaaaccgttacccttttcccccgtacgtaaccggtttccgggaccgggtaacgggaacccttaaaggggtcgacgtacgtaacgaaacggttccgttaaacgttggtagggccttacggaccacccgtaagttccgtttcg

SEQ ID NO: 367609 - DNA, 650 bp, Homo sapiens
  misc_feature: GZ8MTXP01BKLD2.19.57.F02.1.454.CMB.2.raw
  modified_base (197)..(197): a, c, t, g, unknown or other
  modified_base (256)..(256): a, c, t, g, unknown or other
  modified_base (412)..(412): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatcaccatcacttggcgggcagtcaggtatattagggcgctcgttaggctggtancagcagaaagcaacgggaacccctagctcctgatctagtggtgcatcctacgtttagggaaacgttcggggtcccctagaaggttccaggcggacagtggaatcgtgggacagtatttcgactctcgcatcagcagcctgacagtactagtaagtntttgacttaacttttattttacgtactaacgtaacggtaccttaaaccgtcccttttaccccctacgttacccggtttccgggggaccggggtaaacggggtaaccccggtaaagggggttcgggaaacggtaaaccgttaccggaaacggtaccggttaaaccggttgggttccggggaaccttaccggaaccctaaccccgtttagtttcccgtttaaccgtttccgtttaacccg

SEQ ID NO: 367610 - DNA, 523 bp, Homo sapiens
  misc_feature: GZ8MTXP01AWEDJ.19.57.F02.1.454.CMB.2.raw
  modified_base (254)..(254): a, c, t, g, unknown or other
  modified_base (319)..(319): a, c, t, g, unknown or other
  modified_base (415)..(415): a, c, t, g, unknown or other
  modified_base (512)..(512): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcaggaacccctagctctgatctatggtgcatccatttggaaagttcgggtccctnaaggttcagcggtcaggtggaatcgtgggacagtattcactctcgccatcagcacgcctgacagacttgaagtatttcgtactaactttagttttntacaactacggtacttaacctacctttcccctctacctttcggacggtagggaccaagggtcggagattcgaacgcgaacgttgttggctgccaacnttcttgttctc

SEQ ID NO: 367611 - DNA, 591 bp, Homo sapiens
  misc_feature: GZ8MTXP01A9C82.19.57.F02.1.454.CMB.2.raw
  modified_base (201)..(201): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgctcgtaggctggtatcagcaagaaagcaacgggaaaccccctaagctacctgatctatggtgcatcctacgtttaggaaacggtcgggggtcccctcgaaacgggttcaggtcggcaaggtggaatcgtgggacagtatttcactctcgccatcagcagcctgcagactagaacgttattttacgacttaacttttatttttcgactaacaggtaccttaaccttacccttttccccctctaccgttttccgggcgggtaacgggaacccgttaaagggtcggaagtacgtacgaaacggcgttaaacgtgggtacggtcttacggccttaaccgtaacttcgtttcg

SEQ ID NO: 367612 - DNA, 549 bp, Homo sapiens
  misc_feature: GZ8MTXP01CB2T7.19.57.F02.1.454.CMB.2.raw
  modified_base (197)..(197): a, c, t, g, unknown or other
  modified_base (461)..(461): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaggatattaggcgctcgttaggctggtatcagcagaaagcaacgggaaaccccctaagctcctagatctatggtgcatcctagtttggaaagttcggggtcccctagaaggttccaggcggcaggtggaatcgtgggacagtatttcactctcgccatcagcagcctgacagactgaagttatttgacttaactttagttttcgactaacagtacctaacctccctttcccctntaccgtttccgggcggtaacggaccgtaaggttggaagtattcgaaagcgaacgttggttacggctgcctcattcgtcgttcttaacc

SEQ ID NO: 367613 - DNA, 571 bp, Homo sapiens
  misc_feature: GZ8MTXP01AMJPR.19.57.F02.1.454.CMB.2.raw
  modified_base (261)..(261): a, c, t, g, unknown or other
  modified_base (307)..(307): a, c, t, g, unknown or other
  modified_base (385)..(385): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcagggatagttaggcgctcggttaggctggtancagcaagaaacgcgaacggaaccccctagctcctgatctagtggtncatacctagtttagggaaagttcgggtccctagaaggttccaggcgcgagtgaatcgtgggactagtatttcacgtcncgacatcagcagccgtgacagtactagtaacgttagtttcgaactttaatttgttttacgaccaaacgtacgttaacctacccttacctttccccctagtaccgttcggacggtacggcgaaaggtggaagacttacgaaagtcgacgttggaggcttagcctaatcgttcgtaacgttcttcccg

SEQ ID NO: 367614 - DNA, 730 bp, Homo sapiens
  misc_feature: GZ8MTXP01BV50Z.19.57.F02.1.454.CMB.2.raw
  modified_base (197)..(197): a, c, t, g, unknown or other
  modified_base (253)..(253): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgctcgtaggctggancagcagaaagcaacgggaacccctaagctcctgatctatggtcgactactaccctaacgtttagggaaacgttcgggggtacccctacgtaaacggttcccgaacgggccggacgtaagggtggtaaacgttccggttgggggaacctaaggttaactttttaccaaccgtttaccgtccggaaccctacttaccgaacgcgtaacggcccttaggaccctaagggtaacctaggtaaaacggttatttttacggtaactttaaaccggtttttagttttttacggtaacctaaacgtacggtaccctttaaaacccgtcccctttttacccccttacgtaccgttttccgggggaccgggaacgggtaacccgtaaaggggttacggaaggtacgttacgaaagggtcccgttaaaggttcggttacgggttctacggaaccgtacctaacggttccgttaacgttctttaacccg

SEQ ID NO: 367615 - DNA, 584 bp, Homo sapiens
  misc_feature: GZ8MTXP01BUSBR.19.57.F02.1.454.CMB.2.raw
  modified_base (221)..(221): a, c, t, g, unknown or other
  modified_base (254)..(254): a, c, t, g, unknown or other
  modified_base (374)..(374): a, c, t, g, unknown or other
  modified_base (405)..(405): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggnagtcaggatattaggcgctcgttaggctggtancagcagaaagcaacgggaaacccctaagctcctgatctatggtgcatccatttgggaaagttcggggtcccctgaagttccaggcggcaggtggaattcgtgggactagtatttcactcncgccatcagcacgctgacagactagaagttntttacgacttaactttagttttcgtactaacgtacggtacttaaacctccctttacccctactaccgtttcgggacggtacgggtaaccgtaagggtcggagtaacgttacgaaacggcgttaaacgttggttacggtaacgtcgaacctaacctacttcgtttcgttccgtttaaccg

SEQ ID NO: 367616 - DNA, 816 bp, Homo sapiens
  misc_feature: GZ8MTXP01BI5PG.19.57.F02.1.454.CMB.2.raw
  modified_base (197)..(197): a, c, t, g, unknown or other
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatcaccatcacttggcgggcagtcaggatagttaggcgctcggttaggctggtancagcaagaaagcgaacgggaaaccccctagcctcctgactctagtggtgctatcccgtagtttagggaaacggttccgggggtacccctagtaaacggtttcccgaacggcggacgaggttacggaaacgttccggttgggggaaacctaaggtaactttttacccgaacccgttcccgtaccggaccctaacttaccgaaacggccgaaccgggtccccttagggtaaccccgaaagggttaacccgtttaaagggttaaaaccggtttaattttttaaccggggtaaacctttttaaaacccttttttaagggtttttttttaacgaacccgttaaaaaccgttaaccgggtttaacccttaaaaccccgtttacccctttttaccccccgttaaccgtttaacccggttttacccgggggaaccgggtaaaccggggtaaacccggtaaaggggttagaaacgggtaacttaacggaaacggtaccggttaaacgttcgggttacgggtaacctcggtaaccctaccgtacttcccgttcggtttccgtttaacccg

SEQ ID NO: 367617 - DNA, 704 bp, Homo sapiens
  misc_feature: GZ8MTXP01CE8C2.19.57.F02.1.454.CMB.2.raw
  modified_base (304)..(304): a, c, t, g, unknown or other
  modified_base (676)..(676): a, c, t, g, unknown or other
tcagtactctcgtgcacgaccggtgctcgatttagctcgatatagttgggtttgggggagtcagacccagtcaggacacagcatggacatgagggtccccgctcagcccctggggctcctgctgctctggttcccaggttccagatgcgacatccagatgacccagtctccatcttccgtgtctgcatctgtaggagacagagtcaccatcacttggtcgggcagtcaggtatagttagggctctcggttaggctggtatcagcagaaagcaacgggaaaccccctaagctctgatctatggtnctatccgtaacgtttagggaaacggttccgggggttaccccctaggtaaacggttcgaaccggtccgggacgtaagggtggaacttcggttaggggaacctaggttaaacttttcccgaacttccgtcgtaccctataccagaccacgccctagacaacgtacgtagtaaagttagtttacgaacttaaacgttttagtttttacggaactaaacgtacggtaacccttaaaccttaccccgttttaccccctacgttaaccggtttccggggaaccgggtaacgggtaacccgtaagggttaacgggaagttacgttaacggaaacggtaccggtaacgttggttcgggttaccttcggaccctaaccgtnttaccgttcgttccgttaaccgtaaccc

SEQ ID NO: 367618 - DNA, 634 bp, Homo sapiens
  misc_feature: GZ8MTXP01DYHCO.19.57.F02.1.454.CMB.2.raw
  modified_base (182)..(182): a, c, t, g, unknown or other
  modified_base (221)..(221): a, c, t, g, unknown or other
  modified_base (255)..(255): a, c, t, g, unknown or other
  modified_base (621)..(621): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtcctccatcttccgtntctgcatctgtaggagacagatcaccatcacttgcgggnagtcaggatagttaggcgctcgttaggctggtancagcaagaaagcgaaacgggaaaccccctaagcctcctgattctagtggtgctactcctaacgtttagggaaacggttccggggtacccctagtaacggtttcccgaggtcgggacaggttcggaattacgttggggactaagtactttacacctctacgcccatcgagcgacgcctgaccgagacgtagaaagttactttagaacctttaaattttagtttttacgtaactaaacgtacggtacccttaaacctcccttttaccccctagttacccgtttcggggacggttaaacgggacccgaaagggttcggaaggtacttacgaaacggtcgaacgttggacggtctacggaacctaacctnttcttcgttcttc

SEQ ID NO: 367619 - DNA, 583 bp, Homo sapiens
  misc_feature: GZ8MTXP01AZXZ8.19.57.F02.1.454.CMB.2.raw
  modified_base (259)..(259): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcagtcaggtatattagggcgctcgttaggctggtancagcagaaagcgaacgggaaaccccctaagctccgtgactcgtatggtgctatccacgtttaggaagttcggggtccctacgaaggttccaggtcggcgtagtggaaatcgtgggacagtactttcactcgtcgacctatcagcacgcctgaccagactagaagtatttagacttaactttaggttttcgtaactaacgtacgtacttaaacctccctttacccgtccttacgttccggacggtagggacctaaagggtcgagattacgaaacggtcgaaacgttggttacgctacggcacctattccggttgttcgttaaccg

SEQ ID NO: 367620 - DNA, 556 bp, Homo sapiens
  misc_feature: GZ8MTXP01D7NT2.19.57.F02.1.454.CMB.2.raw
  modified_base (255)..(255): a, c, t, g, unknown or other
  modified_base (329)..(329): a, c, t, g, unknown or other
  modified_base (542)..(542): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcacgggaaaccccctaagctcctgatctatggtgcatccacgtttggaaagtcggggtcccctnaacggttccaggcggcaggtggaatcgtggggactaggtatttcactctcgccatcagcagcctgacagactgaagtattttgacttaaactttagtttttcgtacctaaactacggtaccttaaacctccctttccccctactaccgtttccgggaccggacgggacccgaaagggtggagacttcgaaagtcgaacgttgaggctgaaccnccattctgttcttc

SEQ ID NO: 367621 - DNA, 595 bp, Homo sapiens
  misc_feature: GZ8MTXP01B2A2M.19.57.F02.1.454.CMB.2.raw
  modified_base (254)..(254): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaagcgaacggaaacccctaagctcctgatctagtggtgcatccctacgtttagggaaaggttcgggggtcccctagtaacggttccaggcggcaggtggaatcgtgggactagtatttcgactctcgaccatcagcacgcctgacagactagaagtatttcgacttaactttattttcgtacaaacgtacggtaccttaaaccttaccctttcccctacgttaccgtttccgggacgggtaacggaaccggtaacgggtaggaaggtaacttacgaaacggtacgttaaacgttcggttcggaactcggaacctaccattctcgttcgttaacc

SEQ ID NO: 367622 - DNA, 622 bp, Homo sapiens
  misc_feature: GZ8MTXP01C41OH.19.57.F02.1.454.CMB.2.raw
  modified_base (306)..(306): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcattgtcgggcagtcaggatagttaggcgctcgttaggctggtatcagacaagaaagcaacgggaaccccctaagctcctgatctagtggtnactactccgtacgttaggaaacggtcggggtaccctacgaaggttcaggcggcgaaggtgggcgtcgtaggggaactagtacttcactctacgccatccgagtcacgcctgacaagtacgtaagtaagttacgttttacgaacgtttaaactttttagttttacgactaaactcggtaaccttaaccttacccctttcccctacgtacggtttccgggacgggtaaacgggtaccgttaagggtcggaagtaacgtacgaacggttccgttaaggtggtacgggtcttacggacttaaccttaacttcgtttaacc

SEQ ID NO: 367623 - DNA, 679 bp, Homo sapiens
  misc_feature: GZ8MTXP01DYMEY.19.57.F02.1.454.CMB.2.raw
  modified_base (266)..(266): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcggggcgagtcgaaggtatagtacggcgcgttcggttaggctaggtancgagacaaaggaaacgaccgaaaccggaaacccctaagcctccgtagactctagtggcactacttaccgtacgtttaagggaaacggttcccgggtaccctaggtaacggttccaacgggcggagtaggtggtaaacttcgtggggaacctaagttactttaccgaaccgttccgacgtaccctatacgaacgacacggtcctagaacgtaagtacgtaggtaaatttagtttacgaactttaaactttttagttttacgaactaaacgtacgttaacctaaaccttcccctttacccgttacgtacggttcgggacgggacgggtaacgaagggtgacgtacgacgaaaggtccgttaaagttgggttacgcgtacgaaccttaacgtcttcgttcgttaacccgttaaccg

SEQ ID NO: 367624 - DNA, 637 bp, Homo sapiens
  misc_feature: GZ8MTXP01CQ5PM.19.57.F02.1.454.CMB.2.raw
  modified_base (259)..(259): a, c, t, g, unknown or other
  modified_base (293)..(293): a, c, t, g, unknown or other
  modified_base (353)..(353): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttgtcgggcgagtcaggatagttaggcgtctcggtaggctggtancagcagaaagcgaacgggaaacccctaagctccngactcgtatggtgcatcctacgttagggaaagtcgggtccctagaacggttccaggcggngtacggtggaactcgtgggaactaggtaactttccgaacttccgtacgcctaagttccaaggactacggccctagacctagtaactagtaagttatttcgaacttaacttttagttttacaacgtaacaacggtaccttaaacctaccctttcccctaacgttaccgttccgggaccggtaacgggacccggtaaagggtggacgttacgacgtaaacggacgttaacgttgggttacggtctacgggcctaaccgtcttaccgttaacggtttctttaacccg

SEQ ID NO: 367625 - DNA, 600 bp, Homo sapiens
  misc_feature: GZ8MTXP01D4JQN.19.57.F02.1.454.CMB.2.raw
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtancagcagaaaagcaacgggaaaccccctaagctcctgatctatggtgcatcccagtttggaaagttcgggggtcccctcgaaggttccaggcggcagtggaatcgtgggacagtatttcactctcgccatcagcagcctgacagtactagaagtatttgacttaaactttagtttttacgtactaaacgacggtacctaaacctcccttttaccccctacgtaccgttttccggggacggtaacggggaaccctaaaggggttcggaacgtacttacgtaaacgtccggttaaaccgttggttacgggcttcggaacctacccgtattcgttcgttcctttaaccg

SEQ ID NO: 367626 - DNA, 779 bp, Homo sapiens
  misc_feature: GZ8MTXP01C5U6L.19.57.F02.1.454.CMB.2.raw
tcagtactctcgtgcacgaccggtgctcgatttagctcgatatagttgggtttgggggagtcagacccagtcaggacacagcatggacatggacgggtccccgctcagctcctggggctcctgctgctctggttcccaggttccagatgcgacatccagatcgacccagtcctccattcttccgtgtctgcatcgtggtaggagacagacgtcacatcacgttggtcgggcgagtcaggtattagttagggcgtcgttcggttaggctaggtatcgagacgaaaggaaaacggaccgaaaccggggtaaaacccccctagcccttaccgtagtacttacgttaggttcggttcgacctactttaccccgtttaacggtttacggggtaaacggggtttcccgggggtacccccttaggtaaaccgggtttccccgacgggtccgggacgtagggtcgggtaaacgttcgggttcgggggaactaacgggtttacttttccgacccgttacgttcccggacctaacttccgaacggcgaaccggtccgttacggaccgtaaaggtaccgttaaggttaaacggttattttacggtaactttaaacgtttttacgtttttacggtaacctaaacgtaccggtaaccttaaccccgttaccctttccccgttaccttacggttccgggacgggaacgggtaaccgtaaggggtgaacgtacgacgtaaacggcgttaacgttgggttacgcgtacgaacctacctattctcgttctttaacc

SEQ ID NO: 367627 - DNA, 643 bp, Homo sapiens
  misc_feature: GZ8MTXP01BGJKN.19.57.F02.1.454.CMB.2.raw
  modified_base (314)..(314): a, c, t, g, unknown or other
  modified_base (369)..(369): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggtatagttaggcgtcgtcggttaggctggtatcgagcaagaaacgcgaacgggaaaccccctaagcctcctgactctagtggtnctactcctaagtttagggaaacggttcgggtacccctagaacggttccaggcggngtaggtggaatcgtgggactagtactttccgactcctcgaccatcagcacgcctgacagtactagaaagttatttacgactttaaacgttttagtttttacgaactaacgtacggtaccttaaacccttccctttacccctacgttaccgtttccggggacgggtaacgggtaaccggtaaggggtggaacgtaacgttacgaaacggtacgttaaaccgttggttacgggcttacggaaccgtaccctagttcccgttcgtttcctttaaccg

SEQ ID NO: 367628 - DNA, 608 bp, Homo sapiens
  misc_feature: GZ8MTXP01AXYB0.19.57.F02.1.454.CMB.2.raw
  modified_base (258)..(258): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgctcgttaggctggtancagcagaaagcgaacgggaaaccccctagcctcctgatctagtggtgctactcctagtttagggaaacgttcgggggtacccctagtaacggttccaggcggactaggtggaatcgtgggactagtatttccactctcgccatcagcagcctgacagactagaattgtttagacttaactttagttttagactaacgtacggtaccttaaacctcccgttttacccctactacccggtttcgggacgggtaacgggaaccgtaagggtggaacgtacttacgaaacggtcgaaacgttggttacgggtctcggaacctaaccgtacttaccgttcgttccgtttaacccg

SEQ ID NO: 367629 - DNA, 664 bp, Homo sapiens
  misc_feature: GZ8MTXP01BOOL9.19.57.F02.1.454.CMB.2.raw
  modified_base (259)..(259): a, c, t, g, unknown or other
  modified_base (292)..(292): a, c, t, g, unknown or other
  modified_base (305)..(305): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttggtcgggcagtcaggattagtaggcgtcgtcggttaggctggtancagacaagaaagcgaacggaaacccctagctcngatcgtagtggtnacactcccgtagtttagggaaacgttcggggtacccctagaacggttccgacggcggacaggtcggtaagtcgtgggaactaggtactttccacttcgtacgcctatcacgcacggcctagacgagtactagaagttactttcgtaacttaacttttacggtttagtaaccgtaaacgtacggttaacctaacccgttaccctttaccccctacgtttacccgtttaccgggaccgggtaaacgggtaccggtaaacgggttggaacggtacgttaaccggaaacggtccgttaaaggttcggttacggtccgtacggtaaccctaacgtacgtttccgttcggtttaacccgtttccg

SEQ ID NO: 367630 - DNA, 580 bp, Homo sapiens
  misc_feature: GZ8MTXP01EYA3Y.19.57.F02.1.454.CMB.2.raw
  modified_base (196)..(196): a, c, t, g, unknown or other
  modified_base (257)..(257): a, c, t, g, unknown or other
  modified_base (375)..(375): a, c, t, g, unknown or other
  modified_base (378)..(378): a, c, t, g, unknown or other
  modified_base (534)..(534): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggnacagagtcaccatcacttggtcgggcgagtcaggtatattaggcgctcgttaggctggtancagcagaagcgaacgggaaaccccctaagctcctgatctagtggtgctatcctacgtttagggaaacggttcggggtcccctgtaacggttccaggcggcaggtggaatcgtgggacngtntttcactctcgacatcagcacgcctgacatctagaagttatttcgactaactttttaggcttaccaacgtacgtacctaaacttacccctttcccctactacgttccgggacggggacgggaaaccgtaagggtagggacgacttacgaaacgggnaacgttacgttcggtcggcgtcgtccgaccttactcgttcgttccg

SEQ ID NO: 367631 - DNA, 659 bp, Homo sapiens
  misc_feature: GZ8MTXP01B1JN4.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatcgtgtaggagacagagtcacctatctacgttggtcgggcagtcgaggtatagttaggcgtcgtcggttaggctggtatcgagacgaagaaacgccgaacggaaaccccctagcctctgactctagtggtgactactacccgtaagtttacgggaaacggttccgggtacccctagtaacggttcccagggtcggacgtaggtgggaaacttcgggtggggaacctaggttactttaccacttcgtccgacctatacgacggacacgtcccgtagacgtagtacgtagtaagttatttacgactttaacgtttagttttacgaactaacgtacggtaccttaaccctcctttaccccgtacgttaccggttacggggaccgggtacgggaaccgtaagggtggaacgtacgacgaaacggtacgttaacgttggttacggctcgaacctacctagttccgtcgttcttaacc

SEQ ID NO: 367632 - DNA, 617 bp, Homo sapiens
  misc_feature: GZ8MTXP01BFOAP.19.57.F02.1.454.CMB.2.raw
  modified_base (197)..(197): a, c, t, g, unknown or other
  modified_base (244)..(244): a, c, t, g, unknown or other
  modified_base (309)..(309): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaaggatagttaggcgtntcgttaggctggtatcagacagaaacgcgaacgggaaaccccctagcctcctgactctagtggtnctactccgtacgtttagggaaacggttccgggggtacccctagtaacggttcccacggcggtcgaaggtcggaaattcggtgggactagtactttccacgttctcgtcactcgacgcgacgcctagacgtaagtacgtagtacgttatttacgaactttaactttagtttacgtacaacgtacgtaaccttacctacccttccctacgtacggttcggacggtaacggtacgtaaggtcgagtacttacgaacggtcgttacgttcggacgtctcgaaccgtacctgttccgttcgttccgttaaccg

SEQ ID NO: 367633 - DNA, 721 bp, Homo sapiens
  misc_feature: GZ8MTXP01CUGLN.19.57.F02.1.454.CMB.2.raw
  modified_base (310)..(310): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtcctccatcttccgtgtctgcatctgtaggagacagagtcaccatcattggcgggcgagtcaggtattagttaggcgtcgtcgttaggctggtatcagcaagaaacgcgaacggaacccctagctcctgatctagtggtnactatccgtacgtttagggaaacggttcgggggtaccccctacgtaacggttcgaggtccggacgtaacgggtggtaacgtcggtaggggaactacggtactttccgaccttccgtacccgtacctaacgttaccgacggtccaacggtccccgttaggacccgtaaggtaaccgttaggtaaagtttaacgtttttttacggtttaaacctttttagttttttacggtacctaaaccggtacggttaacccttaaacccgttacccctttttcccccgtacgttaccggtttaccggggaccgggtaacgggtaaccgtaagggttcgggaaagacgttaacggaacggttacgttaacgttcggtcgggtaccttcggaccctaccgttactttccggttcgtttcccg

SEQ ID NO: 367634 - DNA, 576 bp, Homo sapiens
  misc_feature: GZ8MTXP01BX8IK.19.57.F02.1.454.CMB.2.raw
  modified_base (302)..(302): a, c, t, g, unknown or other
  modified_base (359)..(359): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcgagtcaggtatagttaggcgctcggttaggctggtatcagcagaaagcacgggaaaccccctagctcctgatctatggtncatcccagtttggaaagtcggggtcccctgaaggttccaggcggcaggtggaatcgngggacagtactttcactctcgcatcagcagcctgacagactagtaagtattttcgacttaactttttagtttttacgtactaaacgtacggtactaaccctaccctttccccctacttaccgtttcgggacgggtacgggaaccgaagggtggagtacgttacgaaagccgaagttggttacgggctcggccaccgtattcctcggttctttaaccg

SEQ ID NO: 367635 - DNA, 567 bp, Homo sapiens
  misc_feature: GZ8MTXP01EAC9T.19.57.F02.1.454.CMB.2.raw
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacgttgtcgggcagtcaggtatagtaggcgctcgttaggctggtancagcagaaagcacggaacccctaagctctgatctatggtgctatcctacgtttggaaagttcgggtccctagaggttccaggcgcgagtggaactcgtgggactagtacttcgactctcgccatcagcagcctgacagtactaggtaacttatttcgacttaactttagttttagactaaacgacgtactaaacctccctttcccctactaccgtttcgggacggtacgggaacccgtaagggtggagaacgttcgaaacggtacgttaacgttggttaggtcctgaacctactattctccgttcttaacc

SEQ ID NO: 367636 - DNA, 638 bp, Homo sapiens
  misc_feature: GZ8MTXP01EZJ9I.19.57.F02.1.454.CMB.2.raw
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtancagcagaaagcgaacgggaaaccccctaagcctcctgatctatggtgcatcctagtttagggaaacggttcgggggtcccctacgaaggtttccaggtcggcaggtggaaatcgtgggactagtactttcactctcgcatcagcagcctgaccagtactagtaagtatttagactaacttttagttttcgtactaaacgacggtaccttaaaccctaccctttacccctacgttacgtttaccggggaccggtaacggggtaaccgaaaggggttcggaaaggtaacttaaccggaaacggaccggttaaaaccgttgggttcggggtaaccttcggaacccgtaacccgtactttaccgttcggttttaaccgtttaaccc

SEQ ID NO: 367637 - DNA, 590 bp, Homo sapiens
  misc_feature: GZ8MTXP01DJKEQ.19.57.F02.1.454.CMB.2.raw
  modified_base (327)..(327): a, c, t, g, unknown or other
  modified_base (386)..(386): a, c, t, g, unknown or other
tcagtactctcgtgcacgaccggtgctcgatttagctcgatatagttgggtttggggagtcagacccagtcaggacacagcatggacatgagggtcccgctcagctcctggggctcctgctgctctggttcccaggttccagatgcgacatccagatgacccagtctccatcttccgtgtctgcatctgtaggagacagagtcaccatcacttgcgggcagtcaggatattagggcgctcgttaggctggtatcagcagaaaagcagggaaaccccctaagctaccctgatctatggtagcatccatttggaaagtcggggtccctnaaggttccaggcggcagtggaatcgtgggacagatttcactctcgccatcagcagcctnctagactgagtattttgactaacttttagttttacgtctaaactaggtacctaaacctacctttcccccgttactaaccgttttccgggacgggtaacggggaacccgtaaaaggggttcgggaaaggattaccgaaaggtcccgaaaagttcggttacggggcttaagggccaaccctacgttcctttcggttccgttttccc

SEQ ID NO: 367638 - DNA, 570 bp, Homo sapiens
  misc_feature: GZ8MTXP01DU5IN.19.57.F02.1.454.CMB.2.raw
  modified_base (254)..(254): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtancagcagaaagcgaacgggaaaccccctaagctcctgatctatggtgctatcctacgttggaaagtcgggtccctgaaggttccagcggcagtgaatcgtgggactagtatttcgactctcgcatcagcagctgacagtactagaagtatttgacttaacttttattttagtctaaactaggtacctaacctacctttccccgtactccgtttccggacggtacggaaccgaaagggtcggagtagttaccaaaggtcgaaacgttggttcggtccgtaggaacccgtacgtacttaccttcgttaaccgttttccg

SEQ ID NO: 367639 - DNA, 573 bp, Homo sapiens
  misc_feature: GZ8MTXP01ERE7K.19.57.F02.1.454.CMB.2.raw
  modified_base (257)..(257): a, c, t, g, unknown or other
  modified_base (284)..(284): a, c, t, g, unknown or other
  modified_base (378)..(378): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacttggtcgggcgagtcaggatagttaggcgctcgttaggctggtancagcagaaagcaacggaacccctagcnctgatctatgtgcatccagtttggaagtcgggtccctgaaggttccaggacggctagtcgaatcgtgggacagtacttcactctgccatcagcngcctgacagtactgaagtatttcgacttaactttatttttcgtacaaacgtaggtaccttaaacctcctttacccccgttactaccgtttcgggacggaacggggtaaccgaaagggttggaggtaacttacgaaacgcgaaacgttgggttacggcgttgaaccgtaacccttacgttcgttcgttccttaacg

SEQ ID NO: 367640 - DNA, 593 bp, Homo sapiens
  misc_feature: GZ8MTXP01C86JR.19.57.F02.1.454.CMB.2.raw
  modified_base (262)..(262): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctggtaggagacagagtcaccatcacgttggtcgggcgagtcgaggatagttaggcgcgtcggtaggctggtancagcaagaaacgcgaacgggaaaccccctagcctcctgatctagtggtgctactaccctacgttagggaaacggttccggggtacccctagtaacggttccgaggcggcgaggtggaatcgtgggactagtacttcactctcgcatcagcacgcctagacagtactagtaagttatttcgtacttaactttagttttacgactaacgtacgtaccttaacctcctttcccctacgtcgttcgggacgggtaacggaccgtaagggtgagtacttacgaagtcgttaacgttggttacggctagaacctactattccgttcgttctttaacc

SEQ ID NO: 367641 - DNA, 653 bp, Homo sapiens
  misc_feature: GZ8MTXP01EVQMR.19.57.F02.1.454.CMB.2.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccattcttccgtgtctgcatctgtaggagacagacgtcaccatcacttgtcgggcgagtcaggatagttaggcgcttcggttaggctggtatcgagacaaggaaacgcgaacgggaaaccccctaagcctcctgactctagtggtgactatccgtagtttacgggaaacggttcggggtaccccctagaacgggtttcaggcggactaagggtggaacgttcgtaggggactaggttacttttacaccttcgtccgacctagtacagcagcctagaccagtactagtaagttattttacgactttaacttttagttttacgaactaaacgtacggtaaccttaaaccttaccccttttacccccgtacgttaccggtttccggggaacgggtaacggggtaacccgttaaaggggttcggaagaacgttacgaaacggcgttaaacgtggtacggcttcggaccttacctaattcgttcg

SEQ ID NO: 367642 - DNA, 813 bp, Homo sapiens
  misc_feature: GZ8MTXP01BWVMB.19.57.F02.1.454.CMB.2.raw
  modified_base (267)..(267): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatcgtgtaggagacagagtcaccatcacgttggtcgggcgagtcaggtattagttaggcgtcgttcggttaggctaggtancgagacaagaaacgaccgaaaccgggaaacccccctaagccttaccgtagtacttacgtaagttcggggtactacctacgtttaccccgttaacggttttaacgggggtaaaacgggtttcccggggggttaccccctacggtaaacggggtttcccgaacgggtcggggtacgtaaggggtcggtaaaacgttccgggtaacgggggtaaacctacgggttaaccttttaccctaaccgtttcccgtacccgggtaccctaagttacccgaacggtaccgacggtcccgttaggaaccgtaacggtaaccgttaaggtaaacgtttacgtttacgtaaacttttaaaccgtttttaggtttttaacggtaaccgtaaaccgtacggttaacccttaaacccgttcccctttaccccgttacgttaccggtttccggggaacgggtaacgggtaaccggtaaggggtacggttaagtaacgttacgaaacggtcgttaaccgttgggacgtcgtcgaaccgtacctagttccgttcgttccgttcc

SEQ ID NO: 367643 - DNA, 594 bp, Homo sapiens
  misc_feature: GZ8MTXP01BFE1W.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcaagggaaaccccctaagctcctgatctatggtgcatcctatttggaaagtcggggtcccctcgaaggttccaggcgcagtggaatcgtgggacagtatttcactctcgcatcagcacgcctgacagtactagaagtatttgactaactttagtttttcgtactaaactacggtacttaaacctaccttttaccccctacgtaaccgttttccggggaccggtaacggggtaacccgtaaaggggttcgggaggtaacgttacgaaacggcgttaaaccgttggttacggtcctcggaacctaccctattccgttcgtttccgtttaacc

SEQ ID NO: 367644 - DNA, 611 bp, Homo sapiens
  misc_feature: GZ8MTXP01EE56U.19.57.F02.1.454.CMB.2.raw
  modified_base (198)..(198): a, c, t, g, unknown or other
  modified_base (222)..(222): a, c, t, g, unknown or other
  modified_base (255)..(255): a, c, t, g, unknown or other
  modified_base (296)..(296): a, c, t, g, unknown or other
  modified_base (355)..(355): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccattcttccgtgtctgcatctgtagganacagatcaccatcacgttgcgggnagtcaggatagttaggcgctcgttagctggtancagcagaaagcgaacggaacccctagctctgatctatggtncatcctagtttaggaagttcgggtccctagacggttccaggtcggcaggtggaactcgngggactagtacttcactctcgacctatacaggcacgcctagaccagtacgtagaagttatttacgacttaacttttagttttacgtactaacgtacggtaccttaaccctacccttttccccgtacgttaccgtttccggggacggtacgggtaacccgtaaagggtggttaacggtacgttacgaaacggtacgttaaacgttgggttacggtcgtacggcctaacccgttacgttccgttaacgttccgtaacg

SEQ ID NO: 367645 - DNA, 576 bp, Homo sapiens
  misc_feature: GZ8MTXP01C92MK.19.57.F02.1.454.CMB.2.raw
  modified_base (254)..(254): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttgtcgggcagtcaggatattaggcgctcgttaggctggtancagcagaaagcaacgggaaaccccctaagctcctgatctatggtgcatccctacgtttggaaaggtcgggggtcccctgaacggttccaggcggcagtggaatcgtgggacagtatttccactctcgcatcagcagcctgcagactgaaagtatttagacttaactttagtttttacgtacaactaggaccttaaacctacctttccccctctacgtttccgggacggacggggaccaagggtcggagtacttacgaaacggcgttaaacgttgggttacggtcgtcggaacctaccgtacgttccttcgttcctttaaccg

SEQ ID NO: 367646 - DNA, 636 bp, Homo sapiens
  misc_feature: GZ8MTXP01AW9TO.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcgaacgggaaaccccctaagctcctgactctatggtgcatccctatttagggaaacgttcgggggtcccctagaaggttccaggcggcaggtggaatcgtgggacagtacttcactctcgcatcagcagcctgacagactagaagtctttgacttaactttagttttagactaaacgacggtaccttaaaacctcccttttacccccgtacgtacccggttttaccgggggaccgggttaaacgggggaacccctaaaagggggttcgggaaaggtaacttaccggtaaaacggtcccggaaacgttttggggaccgggtccttacggggtaacaacccccgtagtttaccccgttttcgtttcccgttaacc

SEQ ID NO: 367647 - DNA, 670 bp, Homo sapiens
  misc_feature: GZ8MTXP01BS5FW.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttgtcgggcagtcaggtatagttaggcgctcgttaggctggtatcagcagaaagcgaacggaacccctaagctctgactctagtggtagctactccctacgtttagggaaacgttcgggggtacccctcgaacggttccgaggcggcaggtggaatcgtgggactagtactttcactctcgaccatcagacgacgcctgacagtacgtagtaaagttcgtttacgactttaaacgttttgtttttacgtaacgtaaacgtacggtaccctttaaacccgttaccccttttacccccgttacgttacccgttttaccgggggaaccgggtaccggggtaacccggtaaagggttacggttaaacggtaacgttaccgaaacggtccgttaaaccggttgggttaccgggaaccttcggaaccctaactacgttacccgttcgtttcccgtttaaccc

SEQ ID NO: 367648 - DNA, 640 bp, Homo sapiens
  misc_feature: GZ8MTXP01EGHC5.19.57.F02.1.454.CMB.2.raw
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacttggcgggcgagtcaggatagttaggcgctcgtaggctggtancagcaagaaacgcaacgggaaaccccctagcctcctgatctatggtgctatccctaagtttagggaaacggttcggggtcccctacgaaggttccaggcggcaggtggaatcgtgggacagtactttcactctcgaccatcagcacgcctagaccgagtacgtagtaaagttatttcgtacttaaactttttagtttttacggtactaaacgtacggtaccttaaacccgttaccccgttttaccccctacgttacccggttttacggggaccggggtaacgggtaaacccgtaaggggttacgggaacggtaacttacggaaacggtacgttaaacgttggttagggcctgaaccctaccgtattccgttcgttcctttaaccg

SEQ ID NO: 367649 - DNA, 743 bp, Homo sapiens
  misc_feature: GZ8MTXP01BROSE.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggtatagttaggcgctcggttaggctggtatcagacaagaaacgccgaaacgggaaaccccctaagcctaccgtagtacttacgttagtcggtacgactacgttacccgtaacgttttaggggaaaaccggtttccgggggttaccccccttacggtaaacggggtttaccccgacgggtacgggaccgtaagggttacggtaaacgttccggttgggggaaacctaagggttacttttaccgaaccttccgtaccgaccctattaccgaacggtccgacggtccctaggaccctaagtaaccgttaggaaagtttacttttacggaacctttaacgtttttaagtttttacggtaactaaaccgtacggtacccttaaaccgtcccctttccccgtacgttccgtttaccggggacggtaacggaaccgtaagggtcggaacgtacacgtaaacggtcgttaacgttcggttacggtccgtcgaacctaccgtattcctaacgttccttaaccg

SEQ ID NO: 367650 - DNA, 599 bp, Homo sapiens
  misc_feature: GZ8MTXP01EFH7D.19.57.F02.1.454.CMB.2.raw
  modified_base (197)..(197): a, c, t, g, unknown or other
  modified_base (254)..(254): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatcacatcacttgcgggcagtcaggatagttaggcgctcggttaggctggtancagcaagaaagcgaacggaaacccccaagctcctgatctatggtgctatccctagtttgggaaagttcgggtccctagaacggttccaggcgcagtggaatcgtgggacagtattcactctcgcatcgagcacgcctggaccagtactagaagttatttagactttaaacttttatttttacgactaaaccgtgtaaccttaacctcccttttcccctagttaccgtttcgggacggtaacgggaccgtaaaggggtcggaagtacgttacgaaacggaccgttaaacgttgggttacggccttcggaaccttaacccgtattccggtttcgttcccgttttccc

SEQ ID NO: 367651 - DNA, 538 bp, Homo sapiens
  misc_feature: GZ8MTXP01AXVLT.19.57.F02.1.454.CMB.2.raw
  modified_base (253)..(253): a, c, t, g, unknown or other
  modified_base (411)..(411): a, c, t, g, unknown or other
  modified_base (500)..(500): a, c, t, g, unknown or other
  modified_base (527)..(527): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgtaggctggtancagcagaaagcagggaaaccccctaagctcctgatctatggtgcactcctacgtttggaaacggttcgggggtcccctacgaacgggttccaggcggcgagtggaacttcgtgggacagtattcactctcgcatcagcagcctgacagactagaagtnttttgacttaacgtttattttgacaaacgacgtacctaacctcctttcccctactaccgttcgggcggtaacgggaccgaagggtgganttacgaagcgacgttggttgctgcacngttctgttctc

SEQ ID NO: 367652 - DNA, 593 bp, Homo sapiens
  misc_feature: GZ8MTXP01AVA23.19.57.F02.1.454.CMB.2.raw
  modified_base (258)..(258): a, c, t, g, unknown or other
  modified_base (300)..(300): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggtatagttaggcgctcgttaggctggtancagcagaaagcgaacggaaacccctagctctgatctatggtnctactcctagtttagggaaaggttcgggtcccctagaaggttccaggcggcagtggaatcgtgggacagtactttcactctcgccatcagcagcctgacagactagaaagttatttcgactttaactttagttttcgtaactaaacgtacggtaaccttaaacccttaccctttacccccgtacgttaccgtttccgggacggtaacgggaaccgtaagggtacggagtacttacgaaacgtacgttaacgttggttacggctcgaacctacctattcgttcgttctttaacc

SEQ ID NO: 367653 - DNA, 608 bp, Homo sapiens
  misc_feature: GZ8MTXP01CB8OE.19.57.F02.1.454.CMB.2.raw
  modified_base (197)..(197): a, c, t, g, unknown or other
  modified_base (256)..(256): a, c, t, g, unknown or other
  modified_base (288)..(288): a, c, t, g, unknown or other
  modified_base (299)..(299): a, c, t, g, unknown or other
  modified_base (353)..(353): a, c, t, g, unknown or other
  modified_base (384)..(384): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatagttaggcgctcgttaggctggtancagcaagaaagcgacggaaacccctagctccngatctatggtncactcctagtttagggaaacggtcggggtacccctagtaacggttccaggcggngtagtggaatcgtgggactagtattcactcncgcatcagcacgcctgacagtacgtagtaagttagtttacgacttaacttttaggttttacgtactaaacgtacggtacccttaaaccttcccctttcccccttacgtaccgtttccggggaccggtaacgggaacccgaagggttacggagtacttacggaaacgtcggttaaacgttcgggttacggtctcggcctaacgtcttcgttcgttcctttaaccg

SEQ ID NO: 367654 - DNA, 627 bp, Homo sapiens
  misc_feature: GZ8MTXP01EJYBL.19.57.F02.1.454.CMB.2.raw
  modified_base (197)..(197): a, c, t, g, unknown or other
  modified_base (221)..(221): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatcaccatcacttggcgggnagtcaggatagttagggcgcgtcggttaggctggtatcagcaagaaagcgaaacgggaaaccccctaagctcctgatctatggtgctatccgtagtttagggaaagttcggggtacccctagaacggttcccaggtcggacaggtggtaacgtcgtggggactagtactttcactctcgccatcagcacgcctgacagactagaagttatttagactttaaactttagttttacgactaaacgtacggtaccttaaacctcccttttaccccacttaccggtttcgggaccgggtaacgggtaaccgaaagggttggaaacgtacgttaacgaaacggtacgttaaccgttggttcgggtaacttacggaacctaaccctattccggttcgtttccgtttaacccg

SEQ ID NO: 367655 - DNA, 766 bp, Homo sapiens
  misc_feature: GZ8MTXP01BSTO8.19.57.F02.1.454.CMB.2.raw
  modified_base (225)..(225): a, c, t, g, unknown or other
  modified_base (739)..(739): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtcctccattcttccgtgtctgcatctgtaggagacagagtcaccatcacttggtcgggngagtcgaaggtatagttagggcgtcttcggttaggctggtatcgagacgaagaaacgacgaaaccgggaaaacccccctaagcctaccgtagtaacttcgtaagtggttcgacctaacgtttacccgtaacggttttaagggggaaaaccggtttcccggggggttacccccttaacggtaaacggggtttccccgacggggtacggggtaccgtaaggggttacgggtaaacgttacccgggttaagggggaaacctaacgggttaaccttttacccgaaccctttcccgtaccggaccctaacgttcgaaaccggtccaacggtccctagggaccctaaggtactagggtaaagttatttacgaactttaacgttttaggttttacgtacgtaaacgtacgtaacccttaaaccgttaccctttcccctacgttaccggtttaccggggaccggtaacgggaacccgtaagggtcgaagtaacttacgaaacggtcgttaacgttggacggntacgctaactgttctcgttcttaaccg

SEQ ID NO: 367656 - DNA, 571 bp, Homo sapiens
  misc_feature: GZ8MTXP01BYBOF.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcggcagtcaggatattaggcgctcgttaggctggtatcagcagaaagcacgggaaaccccctaagctcctgatctatggtgcatcccactttgggaaagtcggggtcccctgaaggttccaggcggcagtggaatcgtggggacagtatttcactctcgccatcagcagcctgacagactgaagtatttgactaactttagttttcgtacaacgtacggtacctaacctcccttttaccccctacgtaccgttttccgggacggtaacgggacccgaagggttggaagtacttacgaaacggtcgaacgttggttcgggtctacggcctacctagttcctcgttcctttaaccg

SEQ ID NO: 367657 - DNA, 563 bp, Homo sapiens
  misc_feature: GZ8MTXP01BDUV6.19.57.F02.1.454.CMB.2.raw
  modified_base (258)..(258): a, c, t, g, unknown or other
  modified_base (289)..(289): a, c, t, g, unknown or other
  modified_base (299)..(299): a, c, t, g, unknown or other
  modified_base (373)..(373): a, c, t, g, unknown or other
  modified_base (543)..(543): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggtatagttaggcgctcgttaggctggtancagcagaaagcgaacggaaacccctagctcngatctatggncatccagtttgggaagtcgggtccctgaaggttccaggcggctaggtgaatcgtgggactagtactttcactcncgtccatcagcacgcccagacgacgtagtaagtatttacgttactaactttacgttttacgttacgtaactaacgtacgtaaccttaccctttccccgttccttacgttccggtcgggacggaacgtacggtaagggagatacgagacggtaacgttagttggcgtgtcncctactcgttctcgttctcc

SEQ ID NO: 367658 - DNA, 616 bp, Homo sapiens
  misc_feature: GZ8MTXP01B8DOV.19.57.F02.1.454.CMB.2.raw
  modified_base (254)..(254): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttgcggcgagtcaggatagttaggcgctcgttaggctggtancagcagaaagcgacggaaaccccctaagctcctgatctatggtgcatcctagtttaggaaagtcgggtccctacgaggttccaggcggcgagtggaatcgtgggacagtactttcactcgtcgcctatcagcacgccgtgaccagtactagaaagttatttgacttaaacttttagtttttacgtaacgtaaacgtacggtaacttaaccctacccttttccccgtacgttaccgttttccggggacgggtaacgggtaacccgtaaaggggttaggacgggtaacttacgtaaacgggtccgaaaccggttggttaccgggtcttcggaacctaccgtattccgttcgttcctttaacccg

SEQ ID NO: 367659 - DNA, 768 bp, Homo sapiens
  misc_feature: GZ8MTXP01DRRDS.19.57.F02.1.454.CMB.2.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccattcttccgtgtctgcatctggtaggagacagacgtcaaccatcacgttggcgggcagtcaggatagtaggcgctcggtaggctggtatcagacaagaaacgccgaaacgggaaaccccctaaagcctaccgtagacttacgtaagttgggtactactaacttaccgttaacggttttaacggggtaaaacgggttcccgggggttaccccccttaacggtaaacggggtttaccgaacgggtcccggggtacgtaaaggggttacgggtaacgttacggttaacgggggaaactaacgggttactttaccgaacttcccgttaccgacctaaaggtccgaacggacctacggtaccgttgaccgtaaggtaacgttaggtaaaacgttattttacgaactttaaacgttttagtttttacgaacctaaacgtacggtaccttaaacccgttacccctttcccccgttacgttaaccggtttccgggaccggggtaaacgggtaaccgttaaggggtacgaaagtacgtaaccgaaagcccggttaaagttcgggcggtaacctcggaccgttaccttaacgtttccgtttcg

SEQ ID NO: 367660 - DNA, 639 bp, Homo sapiens
  misc_feature: GZ8MTXP01EWO62.19.57.F02.1.454.CMB.2.raw
  modified_base (258)..(258): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacccatcacgttgtcgggcagtcaggatattaggcgctcggttaggctggtancagcagaaagcaacgggaaacccctaagctcctgatctatggtgcatccatttggaaagtcgggtcccctgaaggttccaggcggcagtggaatcgtggggacagtatttcacttctcgccatcagcagcctgacagtactagaaagttactttagacttaaacttttatttttacggtacctaaaacgtacggtaccttaaaccctaccctttttaccccccgtacgttaacccgttttccgggggaccgggtaacgggggaaccctaaagggggttggaaacggtaaacgttacccgaaaaggtccgttaaaaccggttgggttacggaaccgttcggaacccgtaacctacttccgttcggtttcccgttttaacccg

SEQ ID NO: 367661 - DNA, 752 bp, Homo sapiens
  misc_feature: GZ8MTXP01CJ4S9.19.57.F02.1.454.CMB.2.raw
  modified_base (228)..(228): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggngagtcagggtattagtaggcgtcttcggttaggctggtatcgagacaaggaaagccgaacgggaaaaccccctaagcctacctgactctagtggtcgactaactccgtagtttagggaaacggttccggggtacccctacgtaacggttcgaggccggacgtaaggtggtaactcggtacggggaaactacggttactttaccaccgttcctaccgaccctaatccgaacgtccaacggtcccctaggaccctaaggtaaccttagggtaaaatttacgttttacggtaaccttttaaacgttttttacgtttttaccggaaacctaaacggttaccggttaaccctttaaaccctttacccccttttaccccccgttaacggttacccggttttacccggggaagggggtaaacccgggttaaacccgaaaggggtttacgggaaacaaacgttaccggaaaacggttccgttaaaccgttgggacggtcctcggacccttaccgtaactttcgtttaacccg

SEQ ID NO: 367662 - DNA, 626 bp, Homo sapiens
  misc_feature: GZ8MTXP01B50CR.19.57.F02.1.454.CMB.2.raw
  modified_base (255)..(255): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcggcagtcaggatattaggcgctcgttaggctggtancagcagaaagacgaacgggaaaccccctaagctacctagatctagtggtgctatacctacgtttaggaaaggttcgggggtcccctacgtaacggttccaggcggcagtggaactcgtgggactagtactttcactctcgcctatcacgcacgcctgacagactaggaattatttacgacttaaactttatttttacgtaactaacgtaacggtacccttaaaccttaccctttccccctaacgtaccgttttccggggaccgggtaacggggtaacccgaaagggttgggaaagaaccgttagaaaacgcggttaaaccgttggttcgggtaactcggtaacaaacccttacgttcgttcgttccgttcg

SEQ ID NO: 367663 - DNA, 522 bp, Homo sapiens
  misc_feature: GZ8MTXP01EW141.19.57.F02.1.454.CMB.2.raw
  modified_base (495)..(495): a, c, t, g, unknown or other
  modified_base (506)..(506): a, c, t, g, unknown or other
  modified_base (511)..(511): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaagggaaaccccctaaagctcctgatctaatggtgcatccactttggaaagtcggggtacccctcaaaggttcagcggcaagtgaatctgggacagatttcactctcgcatcagcagcctgcagatagaagatttatacgtaactttaatttttagttacaaacaagactaactaacctttcccctcctacttcgtcggaacgggacgaaggtaggaggaaatanagacgacgtgngtcgncactcttcgtg

SEQ ID NO: 367664 - DNA, 648 bp, Homo sapiens
  misc_feature: GZ8MTXP01CF4WJ.19.57.F02.1.454.CMB.2.raw
  modified_base (262)..(262): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttgtcgggcagtcaaggtatagttaggcgtcgtcggttaggctggtancagcaagaaacgcgaacgggaaaccccctagctcctgatctagtggtgctatccgtacgtttaggaaacggttcgggtacccctgtaacggttccaggcggcaggtggaatcgtgggactagtactttcactctcgccatcgagcacgccctgacgagtacgtagtaagttatttacacttaacttttagtttttacgtactaaacgtacgtaccttaacctaccctttacccccgtacgttaccgtttccggggaccgggtaacgggtaacccggtaaaggggttaggaacggtaacgttaaccggaaaggtaccggttaaacggttcgggttacggtccgtacggaacctaaccgtacttccggttaacgttccgtttaacccg

SEQ ID NO: 367665 - DNA, 536 bp, Homo sapiens
  misc_feature: GZ8MTXP01DNBMR.19.57.F02.1.454.CMB.2.raw
  modified_base (230)..(230): a, c, t, g, unknown or other
  modified_base (255)..(255): a, c, t, g, unknown or other
  modified_base (349)..(349): a, c, t, g, unknown or other
  modified_base (371)..(371): a, c, t, g, unknown or other
  modified_base (374)..(374): a, c, t, g, unknown or other
  modified_base (377)..(377): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaaggntattaggcgctcgttaggctggtancagcagaaaagcagggaaaccccctaaagctacctgatctatggtgcatccatttggaaatggggtccctcaaggttccagcggcagtggaatntggggacagatttcactctccncancancacgctgacagactagaagtattagtactaactttacgtttagttacgtaacgaacgactaactaccttccctacctacgttcggtacggacgggaacggtaaggtaggagagacgtaacgtacgacgttgttgtcgtcgtcacacttactcgttcgtc

SEQ ID NO: 367666 - DNA, 612 bp, Homo sapiens
  misc_feature: GZ8MTXP01ANSHW.19.57.F02.1.454.CMB.2.raw
  modified_base (261)..(261): a, c, t, g, unknown or other
  modified_base (290)..(290): a, c, t, g, unknown or other
  modified_base (301)..(301): a, c, t, g, unknown or other
  modified_base (348)..(348): a, c, t, g, unknown or other
  modified_base (387)..(387): a, c, t, g, unknown or other
  modified_base (393)..(393): a, c, t, g, unknown or other
  modified_base (397)..(397): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacttggtcgggcgagtcaaggtatagttaggcgctacggttaggctggtancagcagaacgcaacggaacccctagctcngatctatggtncactcctagtttgggaaagttcgggtccctgtaaggttccaggcggntaggtggaatcgtgggactagtactttcactctcgcacncacgcncgcncgacgacgacgtagtagttagttacttacttaactttagtttacgttactaacgtaacgtaccttaaccttaccctttaccccgttaccgttaccgttaccgggtaccgggtaacgggtaacggtaacgggtacggttacgtacgttaacgtaacggtaacgttacggttcggttacggtcgtcgtaaccgacctacgttacttcgttcgttccg

SEQ ID NO: 367667 - DNA, 758 bp, Homo sapiens
  misc_feature: GZ8MTXP01A1C1M.19.57.F02.1.454.CMB.2.raw
  modified_base (264)..(264): a, c, t, g, unknown or other
  modified_base (311)..(311): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcagtcaggtattagttagggcgtcttcggttaggctggtancagcaagaaagcgaacgggaaacccctagctcctgactctagtggtncacttcccgtaacgtttagggaaacggttccgggggtacccctagtaacggttcccgaacggtcggacgtaggtggaacttcgggtaaggggactaaggttactttaccgaccgttcgtaccgacctactacgacgtaccgacgtccgttaggaccgtaagtaaccgttaaggtaaacgtttacgtttttacggtaaccttttaaacgttttttacggttttttaacggtaaccgttaaaccgtacgggttaacccctttaaacccgttccccttttaccccccgttacgttaaccccgggtttccggggaccggggtaaaccggggtaacccggtaaaggggtcgggaaacggtacgttaacggaaacggtaccggttaaacggttcggttacggtaaccgtcggtaaccctaacctacgttccgttcggttaaccgtttaacccg

SEQ ID NO: 367668 - DNA, 594 bp, Homo sapiens
  misc_feature: GZ8MTXP01D91ZQ.19.57.F02.1.454.CMB.2.raw
  modified_base (307)..(307): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgagagacagagtcaccatcacttgtcgggcgagtcaggatataggcgctcgttaggctggtatcgagacaagaaacgcaacgggaaaccccctaagctacctgatctatggtncatcctagttggaaaggtcggggtcccctagaaggttcagcgcgtaaggtgaatcgtgggaacagtctttcgactctcgcatcagcacgcctgcagactagaagtatttagacctttaagtttattttgtaaccaaactacggtaccttaaccttaccctttccccctcgttaccgtttccgggacgggaacgggtaaccgagggtacggttagaacgttacaacggttccggttaaacgttcggtacgggtcttacggacccgttacctaacgttcggtttaaccg

SEQ ID NO: 367669 - DNA, 843 bp, Homo sapiens
  misc_feature: GZ8MTXP01AHEZZ.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatctacttggtcgggcagtcgaaggtatagttagggcgtcgttcggttaggctggtatcgagacaaggaaacgaccggaaccgggaaaccccctaagccttccctagtactctagtggtacgcctacttcccgtaacgttttggggaaacggttcgggggttaccttaccgtacggtaaacggtttccgaacggtccggggtacgtagggttaacgggactttccgggtaggggtaaacctaacgggtttactttacccacgttccgttacccggaccctagttaccgaacggtaccgaaccggtccccgttaggaccgtaacggttaacccgttaagggtaaacgtttaacgttttttacggtaaacccttttaaacgggtttttttacgttttaacggtaaaccttaaacccggttaccggttaaaccctttaaacccctttaaccccccggtttttacccccctaaccggtttaacccgggttttacccggggaaccgggggtaacgggtaaaccgtaacgggggttacggaaacggttaacgtacggtaaacggggttaccccgttaaaggttccggggtcggtacgtaaccggtaccgtaaccttaccggttctttaaccggttttcccg

SEQ ID NO: 367670 - DNA, 606 bp, Homo sapiens
  misc_feature: GZ8MTXP01C24SR.19.57.F02.1.454.CMB.2.raw
  modified_base (294)..(294): a, c, t, g, unknown or other
  modified_base (354)..(354): a, c, t, g, unknown or other
  modified_base (422)..(422): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacgttggtcgggcagtcaggatagttaggcgtcgtcgttaggctggtatcagcaagaaagcgaacgggaaaccccctaagctcngatctagtggtgcatccgtagttagggaaacgttcgggtccctgtacggttccaggcggnaggtggaatcgtgggactagtattcactctcgcatcacgcagccgtgacagtactagaacttagtttntacttaacgttttattttacgactaaacgtacgtaccttaaaccgtccctttaccccgtacgttaccgttcgggacgggaacggggtaaccgtaagggtacggaaggtacttacggtaaacggcgttaaacggttggttacggtaaccgtcgaacctacgtacgttctttcggttccgtttccg

SEQ ID NO: 367671 - DNA, 851 bp, Homo sapiens
  misc_feature: GZ8MTXP01DPQTP.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcgggcagtcgaaggtattagttacgggcgtcgtacggttaggctggtatcgagacaaggaaagaccgaaacgggaaacccccctaagcctcctagtactcgtaagtggttacgacctattacccgtaacggtttacggggaaaacggtttccgggggtacccccttacgtaaacgggtttcccgacgggtacgggtacgtaagggttacgggtaaacgttccggttaagggggaaaccttaagggttaacctttttaccaacccgttccgttacccgaccctaacgttaccgaacggtccgaacggtccccgttaggaacccgtaaaggtaaccgttaaggtaaaacgtttacgtttttaacggtaaccttttaaaccgttttttaggtttttttaaccggaaaccgttaaaaccgttaaacgggttaaccccttttaaaaccccgttcccctttttaacccccccgtacgtttaacccggttttaccggggaacccggggttaaacggggaaacccgtaaaggggtcgggttaaacgtaaacgttaccgaaacgggtccggttaacgttcgggttacggtccgttacgaaccctaaaccgttgttccgtttaacgtttcccgtttaacccg

SEQ ID NO: 367672 - DNA, 773 bp, Homo sapiens
  misc_feature: GZ8MTXP01AE52V.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggtattagttaggcgcgtcgttaggctggtatcagcaagaagcaacgggaaacccctagctcctgatctagtggtcgactataccgtacgtttagggaaacggttcgggggtacccctaggaaacggtttccaaggcggacgtaggtggtaaacttcgtggggaactaaggtactttaccaacgttcgtcgacccctaattcgaacgtccgaaggtcccgttaggaccaacgggtaacctttagggtaaaacgtttacgttttttaacggaaccgtttttaaaactttttaacgggtttttttacgtaaacccgttaaaaccggttaaaccgggttaaccccttttaaaacccctttacccccgtttttacccccccgttaaacgtttaacccggtttttccccgggggaaccggggtaaacggggtaaccccggtaaagggggttacggttaaacgtacgttaacccggaaagggtaccccggttaagttcgggttcgccgttacggaaccctaccgttaggttcctttcggttcccgtttaaccg

SEQ ID NO: 367673 - DNA, 585 bp, Homo sapiens
  misc_feature: GZ8MTXP01CFV00.19.57.F02.1.454.CMB.2.raw
  modified_base (257)..(257): a, c, t, g, unknown or other
  modified_base (302)..(302): a, c, t, g, unknown or other
  modified_base (368)..(368): a, c, t, g, unknown or other
  modified_base (397)..(397): a, c, t, g, unknown or other
  modified_base (420)..(420): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggtatattaggcgctcgttaggctggtancagcagaaagcgaacggaaaccccctagctcctgatctagtggtncatccgtactttgggaaacgtcgggtcccctacgtaaggttccaggcggcgtaggtggaacttcgngggactagtatttcactctcgccatcgancagcctgacgagagtagaagttnttttacgacttaacttttagttttacgtacaacgtacggtaccttaaaccctccctttcccccgtataccgtttcgggacggaacgggtaccaaggggtgagacttacgaacggtcgaacgttggcgggctcggaacctaacctgttactcggtttcttaacccg

SEQ ID NO: 367674 - DNA, 655 bp, Homo sapiens
  misc_feature: GZ8MTXP01AX9X4.19.57.F02.1.454.CMB.2.raw
  modified_base (630)..(630): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctggtaggagacagagtcaccatctacgttggtcgggcagtcaggtatagttaggcgctcggtaggctggtatcgagcaagaaacgcgaacggaaacccctagcctctagactcgtagtggtcactactacccgtaaggtttacggggtaaacggttccgggggttaccccctaggtaaacgggttcccgacgggcggtacgtaagggtggtaaacgttccggtaagggggaactaaggttaaccttttaccacccgttcgtacccggtaccacgttacgacggtccaacggtcccgttgaaccgtaagttacgtaaggtaagttatttacgactttaacgttttagtttacgaactaacgtacgtaccttaacccttcccttccctacgtcgttcgggacggaacggacgaagggtgagtacacgaacgtcgagttggcgntcgaaccatcgttatcgttctaacc

SEQ ID NO: 367675 - DNA, 623 bp, Homo sapiens
  misc_feature: GZ8MTXP01BYEC0.19.57.F02.1.454.CMB.2.raw
  modified_base (197)..(197): a, c, t, g, unknown or other
  modified_base (261)..(261): a, c, t, g, unknown or other
  modified_base (306)..(306): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcgggcagtcagggtatagttaggcgctcggttaggctggtancagcagaaagcgaacggaaaccccctagctcctgatctagtggtnctatccgtacgtttaggaaaggttcgggttcccttagtaacggttccaggcggcgaggtggaatcgtgggactagtactttcactctcgcatcaggcagcctgaccagtacgtaggtaacgttattttacgactttaaacttttagtttttacggaactaaaccgtacggtaccctttaaacccgtccctttcccccgtacgttaccggtttccggggacggtaacggggtaccgtaagggtcggaagtacgttacgtaagtaccggttaacgttggttacgtccgtgcctaccgtattcgttcgtttccgttaacc

SEQ ID NO: 367676 - DNA, 746 bp, Homo sapiens
  misc_feature: GZ8MTXP01AVNR6.19.57.F02.1.454.CMB.2.raw
  modified_base (265)..(265): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccatcttccgtgtctgcatctgtaggagacagacgtcacctatctacgttggcgggcgagtcgaggtatagtaggcgcttcggttaggctggtancgagacaagaaagaccgaaacgggaaaccccctaagcctcctagattacgtagtggtgacctacgttacccgtaacggtttaggggaaaccggttccgggggttacccctaggtaaacggttccgaacggcggacgtaggtacggaacttcggtaaggggaactaagtacgtttaccctacttaccgttaccgaccctaacgtacgaacgcgtaacgtcccgttacggaaccgtacgtaacgttaggtaaaacgttagttttaacgtaaccttttaaacgtttttacggtttttacgtaaaccgtaaacgtaccggttaaccctttaacccgttaaccccttttccccgtaccgtttacccggttaccggggaacggttaccgggaaccgtaaggggtacgaaggtacgttaaacggaaacgtacccggttaagttggcggtaaccgtcgaacctaccgtcttacttcggttccttaaccg

SEQ ID NO: 367677 - DNA, 739 bp, Homo sapiens
  misc_feature: GZ8MTXP01E0C5E.19.57.F02.1.454.CMB.2.raw
  modified_base (220)..(220): a, c, t, g, unknown or other
  modified_base (254)..(254): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcggnagtcaggatagttaggcgctcgttaggctggtancagcagaaagcgaacgggaaaccccctagctccgtgacttctaagtggtacgactacgttccctaacgtttttacgggaaaacggttccgggggttaccccctacgtaaacggggtttcccgaagggcggtacgtaaggttcggaaacttacggttcgggtaaacaaggttaacttttacccaaccgtttccgtccgaccctaagttcgaacggctaacgacccttggaacccaaggtaaccgttaggtaaagttaactttttacggaaacctttaaacgtttttattttttacgtaaccgtaaaccgtacgggttaaacctaaaccctttacccccttttaccccgtaccgttaccggtttccggggaaccgggtaacgggggaaacccgtaagggttaaggttacgaacgttaccggaaggtaaccgaaacggttgttcgggtaacttcggaacctaccgtacttcgttcgttcgtttaaccg

SEQ ID NO: 367678 - DNA, 696 bp, Homo sapiens
  misc_feature: GZ8MTXP01BPFDH.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctcatcttccgtgtctgcatctgtaggagacagagtcaccatcacgttggtcgggcgagtcgaggtatattagggcgcgtcgtcgaggtctggatcgagacaagaaacgacgaaaccgggaaaccccctagcctacctgtatcgtagtggtcgactacgtcctacgtttaggaaacgttcggggtacccctagaacggttcaggcggacgtaggtcggacgtcggtgggaacctagtactttaccgacttcgtccgacctagtcagcctacgcctagacgtagtacgtaaggtaagttatttacgtaacctttaaacgtttttacgttttaccggtaactaaacccgtaggttaccccttaaacccgtttcccgtttacccccctagttacccgggtttaccgggaccggggtaaacgggaaccgtaaggggttaacggacgttaacgttaccggaaggttaccgttaacggttcggtaaccgggtcctaaccgtaacccgtccttaacgttcccgtttcgttaacccc

SEQ ID NO: 367679 - DNA, 743 bp, Homo sapiens
  misc_feature: GZ8MTXP01BY51H.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaggtatagttaggcgctcggttaggctggtatcgagcaagaaagccgaaacgggaaaccccctagcctccgtgactcgtatggtgactactcccgtaagtttacgggaaacggttccggggtacccctacggtaacggtttcccgaacggcggtacgaaggttcgggaaaacttcccggtgggggaacctaagggttaaccttttacccaaccgttccgttaccggaccctaacgttcaacggctaacggtcctacggaccgtaggtaaccttaaggaaagtttattttacgaactttaaacgtttttaggtttttacgtaaccgtaaaccgtacgggttaccttaaacccttacccctttttacccccgtacgttaaccggttttccggggacgggtaaccggggtaaccggtaaaaggggtcggaaacgtacgttacggaaacggtccgttaacgttcgggccgggttaactcggaacccttaacgctttcggttaacgtttccgtttaacccg

SEQ ID NO: 367680 - DNA, 599 bp, Homo sapiens
  misc_feature: GZ8MTXP01D20Q4.19.57.F02.1.454.CMB.2.raw
  modified_base (199)..(199): a, c, t, g, unknown or other
  modified_base (257)..(257): a, c, t, g, unknown or other
  modified_base (302)..(302): a, c, t, g, unknown or other
  modified_base (380)..(380): a, c, t, g, unknown or other
  modified_base (580)..(580): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccatcttccgtgtctgcatctggtagganacagatcacatcacttggcggcgagtacagatagtacggcgactcggtaggctggtancagcaagaaagcgaacgggaaaccccctagctctgatcgtatggnctatcctagtttggaacgttcgggtccctagaagtccgagcggacagtgaatcgtgggactgtatttcactctcgacntcgatcgacgcctcgactacgacttagaagttactttacgtaacttaacgttttacttttacgtaacgtaaacgtacgtaccttaaccttacccctttcccctacgtccgtttcgggacgggtaacgggtaaccgtaagggtcggaagtacgttacgaaacggtacgttaacgttcggacggtcttcggcttaacccgtnttacttcgttccgttaacc

SEQ ID NO: 367681 - DNA, 775 bp, Homo sapiens
  misc_feature: GZ8MTXP01CGARR.19.57.F02.1.454.CMB.2.raw
  modified_base (197)..(197): a, c, t, g, unknown or other
  modified_base (259)..(259): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaggatagttagggcgtctcgttaggctggtancagcaagaaacgcgaacggaaaccccctaagctcctgactctagtggtgctactccctaacgtttaggggaaacggttccgggggtacccctacgtaaacgggtttccgacggtcgggacgtagggtcggtaaacgttcccggttaagggggaaccctaaagggttaacgtttttaccaacccgttcccgttacccgggacccctaaacgttcccgaaacgggtcccaacgggtcccttacggacccgtaaaggtaaccgtagggttaaaacgttagtttttacggtacctttaaaacgtttttaggttttttacggtacctaaacgtacggtacccttaaaccgttaccccttttacccccgttcgttaaacccggttttcggggaccggggtaaacggggtaaaccccggtaaggggttacggacggtaaacgttaccggaaacggtcggttaaaccgttgggttaccgggtctacggtaacctacccgtatttccgttcgttaacgtttcccg

SEQ ID NO: 367682 - DNA, 568 bp, Homo sapiens
  misc_feature: GZ8MTXP01AIX5C.19.57.F02.1.454.CMB.2.raw
  modified_base (230)..(230): a, c, t, g, unknown or other
  modified_base (238)..(238): a, c, t, g, unknown or other
  modified_base (251)..(251): a, c, t, g, unknown or other
  modified_base (407)..(407): a, c, t, g, unknown or other
  modified_base (500)..(500): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggntatggcgntcgtagctggtancagcagaaacgcaacgggaacccctagctcctagatctatgtgcatccagtttaggaaacgtcgggtcccctgaacggttccaggcggcaggtggaatcgtgggactaggtactttcactctcgcccatcagcagtcctggacagactgaacgttntttcggacttaaactttgtttttcgacaactacggtacctaactccctttcccctacgtacgtttccgggacggtacgggcccaaggtcgganacgttcgaaacgtacggacgttcggacggtctcggtcccaacgtcgttcgttaacgttccgtttcccg

SEQ ID NO: 367683 - DNA, 707 bp, Homo sapiens
  misc_feature: GZ8MTXP01BY5TU.19.57.F02.1.454.CMB.2.raw
  modified_base (270)..(270): a, c, t, g, unknown or other
  modified_base (315)..(315): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtcctccattcttccgtgtctgcatcgtgtaggagacagagtcaccatcacgttggtcgggcgagtcgaaggtattagttaggcgtcgtcggttaggctggtancagacgaagaaacgcgaaaccggaaaccccctaagcctctgactntagtggtacgctactaccgtagtttacgggaaacggttccgggtacccctagtaacggttccgagggtcggacgtaaggtcggtaacttcgggtcgggtaactaacggttactttaccaccgttccgtaccgaccagttaccgacgtacacggtccctagaccgagtacgtaggtaaacgtttactttacgtaacctttaaagttttcgttttacggtaacctaaaccgtaaccggtacccttaaacccttccccttttaccccgtaccgttaccggtttaccggggaccgggtaacgggtaaccgtaaggggttacgaacggtacgttacgaaacggtcgttaacgttggttacgtcgtacgaacctactcgttacgttcgtttccgttcc

SEQ ID NO: 367684 - DNA, 622 bp, Homo sapiens
  misc_feature: GZ8MTXP01D1CIS.19.57.F02.1.454.CMB.2.raw
  modified_base (304)..(304): a, c, t, g, unknown or other
  modified_base (355)..(355): a, c, t, g, unknown or other
  modified_base (378)..(378): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatagttaggcgctcgtaggctggtatcagcaagaaagcgaacggaaaccccctagcctctgatctatggtncatcctacgtttaggaaacgtcggggtccctacgaggttcagcgcaagtgntcgtagggacagtacttcactcncgcatcagcagcctgacagactagtaaagttattttcgacttaaactttttgttttacgaaccaacgtacggtaccttaaccttacccttttccccctacgttaccggttttaccggggacggggtaaacggggtaacccgttaaagggggttacgggaacgtaaacgttacgaaaacgggccgttaaaccggtggggtacgggtccttaccgggacccttaacccgtaatttcccggtttccg

SEQ ID NO: 367685 - DNA, 686 bp, Homo sapiens
  misc_feature: GZ8MTXP01AZ1E5.19.57.F02.1.454.CMB.2.raw
  modified_base (197)..(197): a, c, t, g, unknown or other
  modified_base (223)..(223): a, c, t, g, unknown or other
  modified_base (372)..(372): a, c, t, g, unknown or other
  modified_base (413)..(413): a, c, t, g, unknown or other
  modified_base (434)..(434): a, c, t, g, unknown or other
  modified_base (667)..(667): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggngagtcaggatattaggcgcttcgttaggctggtatcagcagaaagccgaacgggaaacccccctaagcctcctgtactctatggtgactagttaccctagtttacgggaaacggttcggggttcccctagtaacggttcccaggtcggngaacggtggaactcgtaagggactaggtactttcacgttcncgaccatccgagccagtccgngtacgacgtacgtacgtaaagttcgttttacgtaaccttaaccgtttttagttttacgtaaccgtaaaccgtacgggttaaacccctttaaacccgttacccctttttacccccgttaaggttaccccggttttacgggggaccgggtaaccgggtaacccgggtaaagggtggttaacgacgttacgaaacgggtccgttaacgttcggttacggccgttggccctaacgtnttccgttcgttcttaaccg

SEQ ID NO: 367686 - DNA, 833 bp, Homo sapiens
  misc_feature: GZ8MTXP01AX0G5.19.57.F02.1.454.CMB.2.raw
  modified_base (197)..(197): a, c, t, g, unknown or other
  modified_base (269)..(269): a, c, t, g, unknown or other
  modified_base (322)..(322): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatccaccatcacgttggtcgggcgtagtcgaaggtattagttagggcgtcgttcggttaggctggtancagacaagaaacgccgaaacggaaaccccctagctcctgactcgtagtggtanactacttacccgtaagtttacgggaaacggttccgggtacccctagtaacggttccgaggaccggtagaggttagggtaacttcgggtaacggggaacttacggtttaactttacccgaccgttcccgtaccggtaccctagttaaccgacggtaccgaacggtcccgttagggaaccaacggttacgttaaggttaaaggtttactttttacggaaaccgtttttaaactttttacggtttttaacgaaacccggtttaaaacgttacccgggtttaaaccttttaaaacccccgtttccccgtttttaaccccccgtttaacgggttaccccgggttttaccgggggaaccggggttaaaccggggtaacccggttaaagggttacgggttaaacgtaaccgttaccggaaacgggtaccggttaaccgggttgggttcccggtaaaccctttcggaacccctttaaccggtacgtttacccctttccggttttaacccgtttaacccg

SEQ ID NO: 367687 - DNA, 610 bp, Homo sapiens
  misc_feature: GZ8MTXP01DZB76.19.57.F02.1.454.CMB.2.raw
  modified_base (257)..(257): a, c, t, g, unknown or other
  modified_base (436)..(436): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccattcttccgtgtctgcatctgtaggagacagagtcaccatcacttggtcgggcgagtcaggatattaggcgctcgtaggctggtancagcagaaagcgaacggaaaccccctaagctacctgatctagtggtgctactaccctagtttagggaaacggttccgggtaccctacgtaaacggtttccaggcggacaggtacggaaagttcgtggggaactaggtatttcaccttctcgactatacagcagcctgacagatgaattntttatacttaacttttattttacgtacaaacgtacgtaccttaacctccctttaccccacgttacgtttcgggacggtacgggaccgtaaagggtgagtacgttacgaaagtcgttaaacgttgggttacggtcgtagaacccctaagtacgttcgttcgttaacgtttaaccc

SEQ ID NO: 367688 - DNA, 653 bp, Homo sapiens
  misc_feature: GZ8MTXP01E0HZG.19.57.F02.1.454.CMB.2.raw
  modified_base (198)..(198): a, c, t, g, unknown or other
  modified_base (262)..(262): a, c, t, g, unknown or other
  modified_base (295)..(295): a, c, t, g, unknown or other
  modified_base (306)..(306): a, c, t, g, unknown or other
tcagtactctcgtgcacgaccggtgctcgatttagctcgatatagttggggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatcaccatcacgttggtcgggcagtcaggtattagttaggcgtctcggttaggctggtancagcagaaacgcgaacgggaaccccctagctcngatctatggtnactactcctacgttagggaacgtcggggtcccctagtaacggttccacggcggtacgaggtcggaacttcggtgggactagtactttcgaccttcgtcgacctatcgacgcacgtccctagaccagtactagtaagttactttcgaacttaacttttagttttacgaactaacgtacggtaccttaaaccctacccctttacccccgtacgttaccggtttaccggggaccgggtaacggggtaacccgtaaaggggttcggaaacggacttaccgaaacggtaccgttaacgttgggttaccgggtctcggaaccctaacctacttccgttaacgttcccttcccg

SEQ ID NO: 367689 - DNA, 607 bp, Homo sapiens
  misc_feature: GZ8MTXP01DFFSP.19.57.F02.1.454.CMB.2.raw
  modified_base (303)..(303): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctggtaggagacagagtccaccatcacttggcgggcgagtcaggatagttaggcgctcgttaggctggtatcagcaagaaagcagggaacccctagctctgatctatggtnctatcctagtttagggaaacgtcggggtaccccctacgaaggttcaggcggctaaggtggaatcgtgggactagtactttcgactctcgacctatcagcagcctgacaggacttagaagttatttcggacttaaacttttagttttacgaacctaaacgtacggtaccttaaaccgttacccttttcccccgttacgttaaccgtttcggggacgggtaacgggtaaccgaaggggtcggagtaacgtcgaaaggttcgttaaacgttggtacggtcgtacggaccttactaacttccgtttcg

SEQ ID NO: 367690 - DNA, 719 bp, Homo sapiens
  misc_feature: GZ8MTXP01CPYSQ.19.57.F02.1.454.CMB.2.raw
  modified_base (258)..(258): a, c, t, g, unknown or other
  modified_base (697)..(697): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacgttgtcggcgagtcaggattagttaggcgctcggttaggctggtancgagacaagaaacgaccgaaacgggaaaccccctaagcctctagactcgtagtggtgactactacccgtaggtttaggaaacggttccggggtacccctagtacggtttccacggcggacgtaggtcggaacttcggtaacggggactaggttactttaccacgtcctaccgacctaacgttccgaacgtccgacgtaccccgtggacctaacggtaccgtaggttaaacgttacgttttaacggtacttttaaacgttttttacggtttttacggaaaccttaaacgtaccggttaaacccttaaccccgtttaaccccttttccccccgttacgttacccggtttaccggggaccggggtaaacggtacccggtaaagggttacggacgtaacgacgtaaacggcgttaacgttggaccgtcgagtaacctaccgtnttccgttcgttccctttaaccg

SEQ ID NO: 367691 - DNA, 676 bp, Homo sapiens
  misc_feature: GZ8MTXP01BEW9T.19.57.F02.1.454.CMB.2.raw
  modified_base (268)..(268): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctagtaggagacagagtcaccatctacgttggtcgggcgagtcgaggtattagttacgggcgtcgtggttaggctggtancgagacgaagaaacgccgaaaccggaaacccctagcctcctgatctagtggcactactccgtacgttagggaacggttccgggtaccctagtaacggttccgacggcggataggtggaagtcggtgggaactagtactttaccactccgtacgacctagtcgaacgctacgcctagaaccgagtaacgtagtaaacgtttactttagtaactttaactttagttttacggaactaaaccggtcgttaacccttaacccttccctttacccccgtacgttaccggtttaccgggggaccgggtaaacggggaccgtaaaggggtgaacggtacttaacgacggtaacgttacgttcgggttcgtaaccgtacgtaacccaacgttcgttcgttcgttaaccgttaaccc

SEQ ID NO: 367692 - DNA, 687 bp, Homo sapiens
  misc_feature: GZ8MTXP01BGICU.19.57.F02.1.454.CMB.2.raw
  modified_base (233)..(233): a, c, t, g, unknown or other
  modified_base (376)..(376): a, c, t, g, unknown or other
tcagtactctcgtgcacgaccggtgctcgatttagctcgatatagttgggtttgggggcaggagtcagacccagtcaggacacagcatggacatggagggtccccgctcagctcctggggctcctgctgctctggttcccaggttccagatgcgacatccagatgacccagtcctccatcttccgtgtctgcatctgtaggagacagagtcaccatcacttggtcgggcagtnaggtatagttaggcgtctcgtaggctggtatcagcagaaacgcaacgggaacccccagctacctgatcgtagtggtcgactactaccgtacgtttaggaaacggttcggggtccctacgaacggttcgagcgcgagtacgggntcgtaggggaactaggttactttccgaacgttcccctaccgaacctaacgacgaacggtccacgtacccgtagacgtaacgtaacgttaaggttaaagtttacgttttaacgtaacgttttaaacgtttttacgtttacgtaaacgtaacggtacgttaaacccttaacccgtttaccccgtttaccccgtacgttaccgggttaccggggaccggggtaaacggtaaccggttaagggtacggaacgtaacgtaacggaacggttcgttaacggttggtcgtccgtacggacccttacgtcgttcgttcg

SEQ ID NO: 367693 - DNA, 694 bp, Homo sapiens
  misc_feature: GZ8MTXP01AI2X8.19.57.F02.1.454.CMB.2.raw
  modified_base (274)..(274): a, c, t, g, unknown or other
  modified_base (338)..(338): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgctatcgtaggtaggagacagacgtcaccgatctacgttggtcgggcgtagtcgaaggtattagtagggcgtcgtcggttaggctggtancgagcgaagaaacgccgaaaccgggaaacccctagtcctcctagtacttcgtagtcgggttacncctacgttacccgtaacggtttaacgggggaaacggttcccgggggttacccctaggtaacgggttcccgacgggcggacgtaggtacggaacttcgggtggggaactacgttactttacccgaccttcgccgaccctatccgaccgacacggcctcggacgtacgtacgtaaggtaattacgtttacgtaacttaacgtttttaggttacgtacgtaaacgtacgtaccttaaaccgttcccctttaccctacgttaccggttccggggacggtaacggggctaaagggtcggagtaacttaggaaacggcgttaacgttggttacggcctagcctacgtcttcttcgttctaac

SEQ ID NO: 367694 - DNA, 796 bp, Homo sapiens
  misc_feature: GZ8MTXP01EVSQG.19.57.F02.1.454.CMB.2.raw
  modified_base (199)..(199): a, c, t, g, unknown or other
  modified_base (274)..(274): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctcatcttccgtgtctgctatcgtggtagganacagagtccacatctacgttggtacgggcgtagtacaaggtatacgttacggcgtcgtacggttaggcgtggtancgaagcgaaagaaacgacgaaaccgggaaaccccctaaggctaccgtgattcgtagtcggtacacgtactcccgttaacggtttacggggtaaaacgttccgggggttaccccgtacgtaaaggtttccccgaagggtacggacggtaaggtcggtaacgttacggtaacgggggtaacctaagggttacttttacccgtaacccgtttcccggtaccgacccgtaaattccgaacgggtaacccgtacgtaccgtacgtaacgtaacggtaagtacggtaaattacgtttacgtaactttaacgtttttaacggtttacgtaaaccgtaaacgttaaccgtaaaccctttaaccccgttaccccgttttccccgtaacggtttaccgggttaccggggaaccggggtaaaccgggtaacgtaagggtaacgttaaacgtaacggttaaccgtaaacggtaccgttacggttcggttacggtaacctcgtaaccctacgtcgttacgtcgtttaaccgtccg

SEQ ID NO: 367695 - DNA, 699 bp, Homo sapiens
  misc_feature: GZ8MTXP01BWQKW.19.57.F02.1.454.CMB.2.raw
  modified_base (260)..(260): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatctacttggcggcgagtcaggtatagttaggcgtctcggttaggctggtancgagacaagaaacgaccgaaaccgggaaaaccccctaagtcctacgtgactctagtggtcgactacgtccgtaacggtttagggaaacggttccgggtacccctagtaacggttcccgaggcggtacgtaggtcggtaacgttcggtaacggggtaactacgttacttttaccgaccttccgtaccgaccctatcgaacggccacgcctgacagtactagtaagttacttagtactttaaccttttagtttacgaaccgtaaacgtacgttaaacccttaacccgttaccccgttttacccctaacggtttaccggtttacccgggggaccggtaaacggggtaacccgtaaagggtcggttaaacgtacgttaacggaaacggtacgttaacggttgttacgccttacgcccttactagttcgttcgttccttaaccg

SEQ ID NO: 367696 - DNA, 692 bp, Homo sapiens
  misc_feature: GZ8MTXP01BJ748.19.57.F02.1.454.CMB.2.raw
  modified_base (200)..(200): a, c, t, g, unknown or other
  modified_base (226)..(226): a, c, t, g, unknown or other
  modified_base (664)..(664): a, c, t, g, unknown or other
  modified_base (676)..(676): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatcgacccagtctccatcttccgtgtctgctatcgtagtagganacagactccacattcacgttggcggngagtacaaggtattagtggcgtacgttcggttaggcgtaggtatcagacgaagaaacgacgaaaccgggtaaaccccctaagtccctacgtagactcttagtggtacgactactccgttacgttaggtaacggtcgggtaccctcgaacggttccgaggtcggacgtaggtggtacttaccgtaaggggtaactaggttactttcctaacccggtttcaccggttaccccaagttccgacgaccgtacggtaccctagtaaccgtacgggtaacctaggtaaacggttacttttacggaacttttaaccgttttaggggtttactaacgtaaccgtacgttaccttaaccttaccccgtttacccgtaccgtccgttacgggacggtacgaccgggtaagtcgaggtaacttgacgtagttacgttcgttcgtcgtancgaactcggttnttccttcgttaacccg

SEQ ID NO: 367697 - DNA, 804 bp, Homo sapiens
  misc_feature: GZ8MTXP01EW6RE.19.57.F02.1.454.CMB.2.raw
  modified_base (323)..(323): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccattcttccgtgtctgcatcgtgtaggagacagagtcaccatcacgttggcgggcgagtcgaggtatagttaggcgtcgtcggttaggctggtatcgagacgaagaaagccgaaacgggaaaccccctaagcctcgtgatcgtagtggtacncacttcccgtaacgtttaggggaaaacggttcggggtaccccctagtaaacgggttccgaacgggtcggacgtaaggtcggtaaacggttaccggtaacggggtacgtaaacggttaccgttttacctaacccgttacccgttaccgtacccctacgttaccgaacggtaccgaccggtaccgttacggaacgttaacggacgttaaggttaaaaccggttacttttaacggttactttaaaccggttttttaacgttttaacgtaaaccgtaaaacccggtaacggttaaaccccttaaaccccgtttacccccttttacccccgtaaccgtttaacgggtttacccggggaaccgggtaacgggtaaaccccggtaagggttaacgggttacgtaaacgttacgtaaacggtaccgttaagttcggttacggtaacgtcgtaaccctaacgtacgttccgtaacgttttccgtaacccg

SEQ ID NO: 367698 - DNA, 598 bp, Homo sapiens
  misc_feature: GZ8MTXP02GXKM5.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaggaacccctaagctcctgatctatggtgcatccactttggaaagtggggtcccctgaaggttccagcggcagtggatcgtggggacagatttcactctcgccatcagcagcctgcagactagaagtattttgactaactttattttgtacaacgtacggtacttaacctacctttacccccctataaccgtttccgggacgggtaaacggggtaccccgtaaaggggttacgggaacgtacgttaccgaaaaggtcccggtaaaaccgttgggttacgggaaccgttcggacccgtaacccgtaagttcccgttaggtttaccctttacccg

SEQ ID NO: 367699 - DNA, 507 bp, Homo sapiens
  misc_feature: GZ8MTXP02INEYW.19.57.F02.1.454.CMB.2.raw
  modified_base (325)..(325): a, c, t, g, unknown or other
  modified_base (503)..(503): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtggggtcccctnaaggttccagcggcagtggatctggggacagatttcactctcgccatcagcagcctgcagactgaagatttgactaaactttatttttgtcaaacaggactaaacactttccccctctactttcggacggagggaccaagggtgagatcaaagcgaaactgtggctgcaccatccttntctc

SEQ ID NO: 367700 - DNA, 589 bp, Homo sapiens
  misc_feature: GZ8MTXP02HHYKR.19.57.F02.1.454.CMB.2.raw
  modified_base (349)..(349): a, c, t, g, unknown or other
tcagtactctcgtgcacgaccggtgctcgatttagctcgatatagttgggtttggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaagggaaccccctaagctcctgatctatggtgcatccactttggaaagtcggggtccctcgaaggttcagcggcagtggntctgggacagatttcactctcgcatcagcagcctgcagactgaagtatttgactaactttattttgtactaaactacggtaccttaaacctacccttttccccctacgtaccgttttaccgggaccgggtaacggggtaaccccgaaaggggttaccgggaaagtaacgtacccgaaaaggtcccggtaaaacgttggttacgggaccttcggaccgaaccccgtaacgttcctttacgg

SEQ ID NO: 367701 - DNA, 551 bp, Homo sapiens
  misc_feature: GZ8MTXP02GY9EW.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaacccctagctcctgatctatggtgcatccactttggaaagtcggggtcccctgaaggttccagcggcagtggatcgtggggacagatttcactctcgccatcagcagcctgcagactgaagtattttgactaaactttatttttgtacaaacgtaggtacttaaacctaccttttcccccctctaaccgttttccgggaccgggtaacggggaccctaaaagggtggaagactccgaaaggtcgaaacgtgtaggcctggaccacctatcctggttctttac

SEQ ID NO: 367702 - DNA, 560 bp, Homo sapiens
  misc_feature: GZ8MTXP02HB9VS.19.57.F02.1.454.CMB.2.raw
tcagtactctcgtgcacgaccggtgctcgatttagctcgatatagttgggtttggggagtcagacccagtcaggacacagcatggacatgacgggtcccgctcagctccgtggggctcctgctgctctggttcccaggttccagatgcgacatccagatgacccagtctccatcttccgtgtctgcatctgtaggagacagagtcaccatcacttggtcgggcagtcaggatagtaggcgctcgtaggctggtatcagcaagaaagcgaacgggaaacccctaagctcctgatctagtggtgcactcctacgtttagggaaacggttcggggtcccctagtaaaggttccaggccggcaaggtgggatcgtggggacagtatttcactctcgccatcagcagctgcagactagaagtatttgacttaaactttatttttacgtacaaacgtaggtaccttaaacctaccctttaccccctactaccgtttcggacgggacggaaccgtaagggtcggagactacgaaagcgtaactgtggctgaccacatctcgttcttc

SEQ ID NO: 367703 - DNA, 525 bp, Homo sapiens
  misc_feature: GZ8MTXP02GRDKM.19.57.F02.1.454.CMB.2.raw
  modified_base (286)..(286): a, c, t, g, unknown or other
  modified_base (320)..(320): a, c, t, g, unknown or other
  modified_base (330)..(330): a, c, t, g, unknown or other
  modified_base (388)..(388): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatataggcgctcgttaggctggtatcagcagaaagcaacgggaaacccctaagctccngatctatgtgcatccatttggaaagtgggccctnaaggtccagngcagtgatctgggacagattcactctcgccatcagcagcctgcagactgaatagtttnactaactttattttgtacaataggactaaacctacctttaccccctctaacgtttccggacgggaacgggaaccctaaacgggtggaaggtataccgaaagcgtaaacgtgtaggctacgcaccatctcgtctttac

SEQ ID NO: 367704 - DNA, 613 bp, Homo sapiens
  misc_feature: GZ8MTXP02HOVI6.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaagcacgggaaacccctaagctcctgatctatggtgcatcctactttggaaagtcggggtcccctgaaggttccagcggcaggtggatcgtggggacagtatttccactctcgccatcagcagcctgcagactagaagtattttgacttaacttttatttttagtactaaactacgggtacttaaacctaccctttaccccctactaccgtttccgggaccgggtaacggggtaacccgtaagggtacgggtaaggtaacgtaccgaaacggtaccggtaaaaccgttgggtacgggtccgttacggacccgtaacccgtaactttccgttacggtttacccgtttacccg

SEQ ID NO: 367705 - DNA, 575 bp, Homo sapiens
  misc_feature: GZ8MTXP02JCTKM.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcaagggaaaccccctaagctcctgatctatggtgcatcccatttggaaagtcggggtccctgaaggttccagcggcagtggatcgtggggacagatttcactctcgccatcagcagcctgcagactagaagtatttgacttaactttattttagtacaaactaggtaccttaaacctaccctttaccccctactaccgtttccgggaccgggtaacggggacccgtaaggggtcggaaggtaactacgaaacggtccgtaaaacgttcggtaggtcgttacggaccaccctatccgttacgttacctttccg

SEQ ID NO: 367706 - DNA, 530 bp, Homo sapiens
  misc_feature: GZ8MTXP02GS6OB.19.57.F02.1.454.CMB.2.raw
  modified_base (450)..(450): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaacgtggggtcccctgaaggttccagcgcagtggatcgtggggacagtatttcactctcgccatcagcagcctgcagactgaagtatttgactaactttatttttgacaactaggaccttaaacctacctttccccctntaccgtttcgggacggtaacgggtaccaaggtggagactacgaaacgcgaactgtacggctgcaccatctcgttcttacc

SEQ ID NO: 367707 - DNA, 560 bp, Homo sapiens
  misc_feature: GZ8MTXP02G1SCY.19.57.F02.1.454.CMB.2.raw
tcagtactctcgtgcacgaccggtgctcgatttagctcgatatagttgggtttgggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaacccctaagctcctgatctatggtgcatccactttggaaagtggggtcccctgaaggttccagcggcaggtggatcgtggggacagtatttcactctcgccatcagcagcctgcagactgaagtatttgactaactttatttttgtactaactaggtactaaacctacctttaccccctctaaccgtttcgggacggtaacgggacccgtaaagggttaggaagtacgtaccgaaaggtccggaaccgtgttagggccttggaccaccctaattccttcgttactttccg

SEQ ID NO: 367708 - DNA, 506 bp, Homo sapiens
  misc_feature: GZ8MTXP02JXHKE.19.57.F02.1.454.CMB.2.raw
  modified_base (327)..(327): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctnaaggttccagcggcagtggatctggggacagatttcactctcgccatcagcagcctgcagactgaagtatttgctaactttattttgtctaacaggctaactacctttccccctctacgtttcggcggtagggaccaaggtggagatacaagcgaactgtggctagcacatctgtcttc

SEQ ID NO: 367709 - DNA, 567 bp, Homo sapiens
  misc_feature: GZ8MTXP02I17FE.19.57.F02.1.454.CMB.2.raw
  modified_base (201)..(201): a, c, t, g, unknown or other
  modified_base (343)..(343): a, c, t, g, unknown or other
  modified_base (348)..(348): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcagtcaggatattaggcgctcgttaggctggtatcagcagaaagcagggaaaccccctaagctcctgatctatggtgcatccactttggaaagtggggtcccctcgaaggttcagcgcngtggntcgtgggacagtatttcactctcgccatcagcagcctgcagactagaagtattttgactaaacttttattttgtactaaacgtacggtaccttaaacctaccttttacccccctagtaccgttttccggggacggtaacggggaccctaaaggggtcggtaaaggacttaccgaaaggtccgaaacgtggtagggactcggccaacctattacgtttcg

SEQ ID NO: 367710 - DNA, 521 bp, Homo sapiens
  misc_feature: GZ8MTXP02J2C6G.19.57.F02.1.454.CMB.2.raw
  modified_base (327)..(327): a, c, t, g, unknown or other
  modified_base (338)..(338): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtcggggtcccctnaaggttccagnggcagtggatctggggacagattcactctcgccatcagcagcctgcagactgaagtattttgactaaactttattttagtctaaacaggtactaacctaccttttaccccctctaacgtttcggacggacgggtaccaagggtggagactacaagcgaacgtgtggctgcaccatctcgtctc

SEQ ID NO: 367711 - DNA, 599 bp, Homo sapiens
  misc_feature: GZ8MTXP02JQOM9.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcaacgggaaacccctaagctcctgatctatggtgcatccactttggaaagtcggggtcccctgaaggttccagcggcagtgatctggggacagtattcactctcgccatcagcagcctgcagactgaagtatttgactaactttattttgtactaacgtacggtaccttaaacctaccctttaccccctactaaccgttttccggggaccgggtacggggaacccgtaaacggggttacggaaggtaacgttaccgaaaacggccggtaaaaccgttggttacggggaacgttcggaccaacccggtaacgttcctttacggttaccttttacccg

SEQ ID NO: 367712 - DNA, 558 bp, Homo sapiens
  misc_feature: GZ8MTXP02I7QFO.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggtatcagcaagaaagcaacgggaaaccccctaagctcctgatctatggtgcatcctacgtttgggaaacgtcggggtcccctagtaacggttccaggcggcaggtggatcgtggggacaggtattcactctcgccatcagcacgcctgacagactagaagtagtttgacttaactttattttacgtactaactacggtactaaacctaccctttcccctctacgtttccggacgggtacgggaccgtaagggtaggagacgtacgaaacggcgtaaacgtgtcggcgtcgcaccgatctcgttcttcg

SEQ ID NO: 367713 - DNA, 541 bp, Homo sapiens
  misc_feature: GZ8MTXP02INE8C.19.57.F02.1.454.CMB.2.raw
  modified_base (399)..(399): a, c, t, g, unknown or other
  modified_base (417)..(417): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggtatcagcagaaagcaagggaaaccccctaagctcctgatctatggtgcatcctacgtttggaaagtcggggtcccctagaaggttccagcgcagtggatcgtggggacagtattcactctcgcatcagcacgctgacagactagaaatntttagacttaaacttttnttttagtacaaacgtagtacctaaacctccctttacccctacgtacgtttcgggacggtacggaaccgaagggttcgaagtactacgaacgaccgtaactgtaggctgaccactatctcttctc

SEQ ID NO: 367714 - DNA, 514 bp, Homo sapiens
  misc_feature: GZ8MTXP02I54PV.19.57.F02.1.454.CMB.2.raw
  modified_base (325)..(325): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcagggaaaccccctaagctcctgatctatggtgcatccactttggaaagtggggtcccctnaaggttccagcgcagtggatctggggacagatttcactctcgccatcagcagcctgcagactgaagatttgactaactttatttttgtcaaacaggactaaactacctttaccccctctaactttcgggacggtagggacccaagggtggagatacaaagcgaactgtaggctgcaccatctgtcttac

SEQ ID NO: 367715 - DNA, 639 bp, Homo sapiens
  misc_feature: GZ8MTXP02IC8PM.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggtatcagcagaaagcacgggaaacccctagctcctgatctatggtgcatcctacgttttaggaaaacggttcggggtcccctacgaacggtttcccaggtcggcaggtggatcgtggggacagtactttcgactctcgccatcagcagcctgcagactagaacgtatttagacttaacttttatttttcgtactaaacgtaggtaccttaaacctacccttttacccccttacgtaccgttttaccgggaccgggtaaacggggtaacccgtaaaggggttacggtaaaggtaaacttaccggaaaacggtaccggtaaaaccgttggttacgggaaccgttcggtaccaaccccggtaatttcccgtttacggtttaccctttacccg

SEQ ID NO: 367716 - DNA, 561 bp, Homo sapiens
  misc_feature: GZ8MTXP02HVUVE.19.57.F02.1.454.CMB.2.raw
  modified_base (201)..(201): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggcgggcagtcaggatattaggcgctcgttaggctggtatcagcagaaagcaacgggaaacccctaagctcctgatctatggtgcatccacgtttaggaaagtcggggtcccctcgaaaggttcagcggcaggtggatcgtgggacagtatttcactctcgccatcagcagcctgcagactgaaagtattttgacttaacttttatttttcgactaaacgtacggtacttaaacctacctttccccctattaccgtttcgggacggtaacgggaaccgtaagggtacgaaggactacgaaacgcgtaaacgtggtacggactcggacctaacctattcttcg

SEQ ID NO: 367717 - DNA, 656 bp, Homo sapiens
  misc_feature: GZ8MTXP02IB1C3.19.57.F02.1.454.CMB.2.raw
  modified_base (196)..(196): a, c, t, g, unknown or other
  modified_base (302)..(302): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcaggtatagttaggcgtctcgttaggctggtatcagcagaaagcaacgggaaacccctagctctgatctagtggtncatcctacgtttaggaaagtcggggtcccctgtaaggtccaggcggcaggtggatcgtggggaactagtactttcgactctcgccactcagcagccctgacagactagaagttatttagacttaacttttattttaggtactaaacgtacggtaacttaaaccttacccttttcccccgtacgttaacccggttttccggggaaccgggggtaacggggtaaaccccgtaaaacggggttacggggaaaggtaacgttaaccggaaaaggtaccggtaaaaccgtttagggttacgggaaccgttcggaacccgtaacccgtaacgtttccgtttaacgtttccgtttaacccg

SEQ ID NO: 367718 - DNA, 516 bp, Homo sapiens
  misc_feature: GZ8MTXP02JSKJS.19.57.F02.1.454.CMB.2.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaacccctaagctcctgatctatggtgcatccactttggaaagtcggggtccctcaaggttcagcggcaggtggatcgtgggacagatttcgactctcgccatcagcagcctagcagactgaagtatttgactaactttatttgtactaacaggtacctaactactttcccctctacgtttcggacgtacgggaccaaggtcgagactacgacgcgaactgtggctacggtcaccatcttcg

SEQ ID NO: 367719 - DNA, 582 bp, Homo sapiens
  misc_feature: GZ8MTXP02I5WEX.19.57.F02.1.454.CMB.2.raw
  modified_base (327)..(327): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctnaaggttccagagcagtggatcgtggggacagatttcactctcgccatcagcagcctgcagactgaagtatttgactaaactttattttgtactaaactaggtaccttaaacctaccttttaccccctactaaccgtttccgggacgggtaaacggggtaacccaaaggggtcgggtaaagacgttacgaaacggtccgaaaacgttggttagggccttcggacctacccgtagttccttacggtttcctttaccg

SEQ ID NO: 367720 - DNA, 621 bp, Homo sapiens
  misc_feature: GZ8MTXP02F6UW4.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgctcgttaggctggtatcagcaagaaagcaacgggaaacccctaagctcctgatctatggtgcatcctacgtttagggaaagtcggggtccctacgtaggttccagcggcaggtgatcgtggggacagtattcactctcgcatcacgcacgctgacagtacgtagtaagtatttgtaacttaaactttagtttttacgactaaacgtaacggtaccttaaaacccttaccctttcccccttacttaaccggtttccggggaaccgggtaacggggaacccgtaaagggtacgggtaagaacgttaacgaaacggtaccgtaaacgttggtacggccttacggaccctaaacccgttacgtttccgttacgtttacctttaccg

SEQ ID NO: 367721 - DNA, 510 bp, Homo sapiens
  misc_feature: GZ8MTXP02GBXL8.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaacccctaagctcctgatctatggtgcatccactttggaaagtcggggtccctgaaggttccagcgcagtgatctgggacagattcactctcgccatcagcagcctgacagactgaagtatttgactaactttattttgtacaactaggactaaacctacctttcccctctactttcggacggtaggaccaaaggtggagactacgaaagcgactgtaggctgcaccatctcgtcttac

SEQ ID NO: 367722 - DNA, 571 bp, Homo sapiens
  misc_feature: GZ8MTXP02GN4RR.19.57.F02.1.454.CMB.2.raw
  modified_base (344)..(344): a, c, t, g, unknown or other
tcagtactctcgtgcacgaccggtgctcgatttagctcgatatagttgggtttggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatattaggcgctcgtaggctggtatcagcagaaagcaggaaaccccctaagctcctgatctatggtgcatccactttggaaagtcggggtccctcaggttcagcgcagtggntcgtgggacagattcactctcgccatcagcagcctgcagactagaagtattttgactaactttattttgtacaaactaaggtctaaactaccttttccccctctaaccgttttccgggacgggtaacgggaacccgtaaaggggttcggaaaggtaacgtaccgaaaaggccggtaaaaccgttgggtacggggtccttacggaccaaacccgtacgttcctttacg

SEQ ID NO: 367723 - DNA, 573 bp, Homo sapiens
  misc_feature: GZ8MTXP02F93SC.19.57.F02.1.454.CMB.2.raw
  modified_base (371)..(371): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtcggggtcccctgaaggttccagcggcaggtggatcgtggggacagtatttcactcncgccatcagcagcctgcagactgaagtatttgactaactttattttgtactaactaggtactaaacctacctttaccccctactaccgtttcgggaccgggtaacgggaacccgtaaagggtcgggaagtacgttacgaaacggaccgtaaaacgtggtacgggcttacggaccacccgtattccgttcggttctttacccg

SEQ ID NO: 367724 - DNA, 543 bp, Homo sapiens
  misc_feature: GZ8MTXP02FTCGX.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcaacgggaaaccccctaagctcctgatctatggtgcatccactttggaaagtcggggtccctgaaggttccagcgcagtggatcgtggggacagtatttcactctcgcatcagcagcctgcagactagaagtatttgacttaaactttattttacgtactaacgtacggtacctaaacctacctttccccctacgtacgtttcggacgggtacggaccgaagggtggagactacgaagtcgaaacgtggtacgcgtcgacacctatctcgtctttac

SEQ ID NO: 367725 - DNA, 619 bp, Homo sapiens
  misc_feature: GZ8MTXP02J2JN8.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcacgggaaacccctagctcctgatctatggtgcatccactttggaaagtcggggtcccctgaaggttccagcgcagtggatcgtggggacagtattcactctcgccatcagcagcctgcagactgaagtatttgactaactttattttgactaaacacggtaccttaaacctacccgttttaccccctacgtaaccgttttccggggaccgggtaaacggggtaaccccgtaaaacggggttagggtaaacgaacgttaaccgtaaacgggtaccggaaaacccgttggggttaacgggccgttacgggtacccgaaccccgtaaagtttcccgtttacggttcctttaaccccg

SEQ ID NO: 367726 - DNA, 578 bp, Homo sapiens
  misc_feature: GZ8MTXP02HW4EQ.19.57.F02.1.454.CMB.2.raw
  modified_base (289)..(289): a, c, t, g, unknown or other
  modified_base (300)..(300): a, c, t, g, unknown or other
  modified_base (344)..(344): a, c, t, g, unknown or other
  modified_base (417)..(417): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgtaggctggtatcagcagaaagcaacggaaacccctagctcngatctatggtncatcctacgttggaaagtcgggtcccctgagttcagcgcagtgntcgtgggacagtatttcacttctcgcatcagcagcctgacagactagaatattttacgactttaaacgttttnttttacgactaaacgtaggtaccttaaaccttccctttcccccttacgtaaccgtttccggggacggttaacgggaccgtaaagggttcggaagtaactaccgaaaacggtccgtaaacgtcggttacggcttacggacctaacccgtagtttcctttacg

SEQ ID NO: 367727 - DNA, 558 bp, Homo sapiens
  misc_feature: GZ8MTXP02GGHY4.19.57.F02.1.454.CMB.2.raw
  modified_base (332)..(332): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgctcgttaggctggtatcagcagaaagcaacgggaaaccccctaagctcctgatctatggtgcatccactttggaaagtcggggtcccctnaaggttccagcgcagtgatctggggacagatttcactctcgccatcagcagcctgcagactagaagtatttgactaactttattttgtacaactaggactaacctacctttccccctactactttccgggacggtacgggaccgtaagggtacggaagactacgaaacggcgtaaacgtggttacggccgtacggacctaaccctacttcgttcgttcctttaccg

SEQ ID NO: 367728 - DNA, 561 bp, Homo sapiens
  misc_feature: GZ8MTXP02F42PU.19.57.F02.1.454.CMB.2.raw
  modified_base (358)..(358): a, c, t, g, unknown or other
  modified_base (396)..(396): a, c, t, g, unknown or other
  modified_base (417)..(417): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggtatcagcagaaagcaacgggaaaccccctaagctcctgatctatggtgcatcctaacgtttggaaagtcggggtcccctacgaaggttcagcggcaggttggntcgtgggacagtatttcactctcgccatcagcagtccngacagactagtaagttatttnacttaatttatttagtacaaacgtacgtactaaccttaccctttcccctactacgttcgggacggtaacggaccgtaaggtacggacgtaacgtacgaaacgtcgtaaacgtggtacgtacgtacgacctaacgtacttcgtcg

SEQ ID NO: 367729 - DNA, 571 bp, Homo sapiens
  misc_feature: GZ8MTXP02F6DO2.19.57.F02.1.454.CMB.2.raw
  modified_base (348)..(348): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcagggaaaccccctaagctcctgatctatggtgcatccactttggaaagtcggggtccctcaaggttcagcggcagtggntctgggacagatttcactctcgcatcagcagcctgcagactagaagtattttagactaaactttatttttagtactaaactaggacttaaaccaaccttttccccctactaaccgttttcgggaccgggtaacggggacccgtaaagggtacgggaaggtaattaccgaaaagtccggaaaaccttcgggttaggccgttaggccaaccctaattctttaccg

SEQ ID NO: 367730 - DNA, 532 bp, Homo sapiens
  misc_feature: GZ8MTXP02HD77A.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcaggaaacccctaagctcctgatctatggtgcatcccactttggaaaacgtcggggtcccctgaaggttccagcgcagtggatcgtggggacagatttcgactctcgaccatcagcagccctgacagactgaagtatttcgactaaactttattttcgttacaactaggtacctaaactacctttaccccctactacgtttcggacggtaagggaccgtaaggtcggaagtactacaacgtcgaactgtaggctgcacatctcgtcttc

SEQ ID NO: 367731 - DNA, 576 bp, Homo sapiens
  misc_feature: GZ8MTXP02JFMGP.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaacccctaagctcctgatctatggtgcatcctatttggaaagtcggggtccctgaagtccagcggcaggtggatcgtggggactagtacttcactctcgccatcagcagcctgcagactagtaagtatttagacttaactttattttacgtactaacgtaggtaccttaacctaccctttaccccctactaccgtttccgggacgggtaacgggtaaccgtaagggttacggaagtaacgtacgaaacggtacgtaaacgtggtacggtctacggacctaccgtacttccgttacgttcctttaccg

SEQ ID NO: 367732 - DNA, 508 bp, Homo sapiens
  misc_feature: GZ8MTXP02H1IWJ.19.57.F02.1.454.CMB.2.raw
  modified_base (201)..(201): a, c, t, g, unknown or other
  modified_base (287)..(287): a, c, t, g, unknown or other
  modified_base (296)..(296): a, c, t, g, unknown or other
  modified_base (340)..(340): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggatattaggcgctcgtaggctggtatcagcagaaagcaggaacccctagctccngatcatggngcatccattggaaagtggggtcccctcaggttcagcggcagtgntctgggacagatttcactctcgccatcagcagcctgctagactgaagtattttgctaaacttttatttttgacaaactggtactaacctactttccccctatacctttcgggacggagggtacccaaagggtcgagactacgaagccgaagtgtggctgcaccatctg

SEQ ID NO: 367733 - DNA, 552 bp, Homo sapiens
  misc_feature: GZ8MTXP02FMVYU.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtcggggtcccctcgaaggttccagcggcagtggatctgggacagatttcactctcgccatcagcagcctgcagactgaagtatttgactaactttattttgctaactaggtactaaacctacctttccccctctaaccgtttccgggacgggtacgggaacccgtaagggtcggaagacgttaccgaaaggccgtaaacgtggtcgggcttggaccacccattcttacgttctttaccg

SEQ ID NO: 367734 - DNA, 545 bp, Homo sapiens
  misc_feature: GZ8MTXP02IRIYY.19.57.F02.1.454.CMB.2.raw
  modified_base (343)..(343): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaacccctaagctcctgatctatggtgcatccactttggaaagtggggtccctcaagtcagcggcagtggntctgggacagtattcactctcgcatcagcagctgcagactagaagtatttgacttaactttattttgactaaactacggtactaactacctttaccccctactaccgtttcgggaccggtaacgggtaccgtaaagggtggtaacgtataccgaaaacgcggtaaacgtcggtacgggtactcggaccaactacttacttcg

SEQ ID NO: 367735 - DNA, 529 bp, Homo sapiens
  misc_feature: GZ8MTXP02FQXG1.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaacccctaagctcctgatctatggtgcatccactttggaaagtcggggtcccctcgaaggttccagcggcagtggatcgtgggacagtatttcactctcgccatcagcagcctgcagactgaagtatttgacttaactttatttttgactaactagggtacctaacctacctttccccctactacgtttcggacggacgggtaccaagggtggagactacgaacgtcgaacgtgtaggctgcacctatctcgtcttac

SEQ ID NO: 367736 - DNA, 582 bp, Homo sapiens
  misc_feature: GZ8MTXP02HE3T8.19.57.F02.1.454.CMB.2.raw
  modified_base (283)..(283): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggtatcagcagaaagcacggaaacccctagctcngatctatgtgcatcctacgtttaggaaacgtcggggtacccctagaacggttccgagtcggcgaggtggactcgtggggactaggtactttcactcgtcgccatcagcacgcctgacagactgtaaagtactttagacttaacttttattttcgtactaaacgtaggtaccttaaacctacccttttacccccgtacgtaaccgttttccgggacgggtaacgggaaccgtaacgggtaggacgtacgtacgaacggtacgtaacgtggtcgaacgtgaccactagtctcgttctttac

SEQ ID NO: 367737 - DNA, 537 bp, Homo sapiens
  misc_feature: GZ8MTXP02HXA71.19.57.F02.1.454.CMB.2.raw
  modified_base (396)..(396): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaagcaggaaacccctagctctgatctatggtgcatcctactttggaaagtcggggtacccctgaaggttccagcggcagtggatcgtggggacagtatttcactctcgccatcagcagcctgcagactgaagtntttgacttaactttatttttgtacaactacggtaccttaaacctacctttccccctctaaccgtttcggacggtacgggaccgtaagggtcggaagactacgaaagcgtaactgtggcgtgaccaccatccgtcgttcttc

SEQ ID NO: 367738 - DNA, 587 bp, Homo sapiens
  misc_feature: GZ8MTXP02JKSAH.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaagcaacgggaaaccccctaagctcctgatctatggtgcatccactttggaaagtcggggtccctagaggttccagcggcagtgatcgtgggacagtatttcactctcgcatcagcagcctgcagactgaatatttgacttaaactttattttcgactaacgtacggtaccttaaacctacccttttccccctagttaccgtttccggggacggtaacggggtacctaaaggggttcggaaagtaacgtaccgaaaggtccgtaaaacggttcggtacggcgttcggaccgtaacctaacggtttccttacggtttcctttaacccg

SEQ ID NO: 367739 - DNA, 767 bp, Homo sapiens
  misc_feature: GZ8MTXP02IKZJQ.19.57.F02.1.454.CMB.2.raw
  modified_base (197)..(197): a, c, t, g, unknown or other
  modified_base (301)..(301): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggatagtaggcgctcgtaggctggtatcagcagaaagcgaacggaaaccccctaagctcctgatctagtggtncattccctacgtttaggaaacggttcggggtaccccctagtaacggttccgacggtccggcgaggtggaacgttcgtagggggtaacctaaggttacttttaccgaaccttccgtaccgaccctaagttccgaacggtaccaacggcccgttaggacctaaacgggtaaccgttaaggtaaaacgggtttactttttacggaaacctttaaaaccgtttttttagtttttttaacggtaaaccctaaaaccgtaacgggttaaaccccttaaaacccgttaccccgtttttacccccccttaacgtttaacccggtttttacccggggaaccgggggtaaacggggtaaaccccgtaaaagggggtacgggtaaacgtaaacgttaaccgaaaacggtaccgtaaaaccgttggttacggaacgttacggacctaacccgtatttccgttacgttacctttacccg

SEQ ID NO: 367740 - DNA, 618 bp, Homo sapiens
  misc_feature: GZ8MTXP02JGVF5.19.57.F02.1.454.CMB.2.raw
  modified_base (350)..(350): a, c, t, g, unknown or other
  modified_base (354)..(354): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaagggaaccccctaagctcctgatctatggtgcatccactttggaaagtcggggtccctcgaagttcagcggcaggtggntcgngggacagatttcactctcgcatcagcagcctgcagactagaagtatttgacttaacttttatttttacggtactaaacgtacggtaccttaaaccgtaccctttttcccccctacgttacccgttttaccggggaccgggtaaacgggggtaacccgtaaacgggggttacgggaaacggtaacgttaccgaaaacgggtccggtaaaacgttcgggtaacgggtccttacgggacctaaccccggttaatttcccgtttacgg

SEQ ID NO: 367741 - DNA, 586 bp, Homo sapiens
  misc_feature: GZ8MTXP02HHDS1.19.57.F02.1.454.CMB.2.raw
  modified_base (196)..(196): a, c, t, g, unknown or other
  modified_base (283)..(283): a, c, t, g, unknown or other
  modified_base (323)..(323): a, c, t, g, unknown or other
  modified_base (454)..(454): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgtctcgttaggctggtatcagcagaagcagggaacccctagctccngatctatggtgcatccactttggaaagtcggggtcccctnaagttccagcgcagtggatctggggactagatttcactctcgccatcagcagcctgcagactagaaagattttcgacttaaacttttattttagtacaactaggtaccttaaacctacctttacccccttntaaccgtttcgggaccgggtaacggggaaccctaaaggggttcggaacgtaagttaccgaaaggtaccgaaaccgttggttacggccgttcggacccgtaacccgtagttccctacggtttcctttaacccg

SEQ ID NO: 367742 - DNA, 589 bp, Homo sapiens
  misc_feature: GZ8MTXP02JFKMT.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatattaggcgctcgttaggctggtatcagcagaaagcagggaacccctaagctcctgatctatggtgcatcccactttgggaaagtcggggtcccctgaaggttccagcggcagtggatctggggacagattcactctcgcatcagcagcctcagactagaagtatttgctaaacgtttatttttgtactaacacggtacttaaacctacccttttccccctacttaccgtttccgggaccgggtaacgggacccgtaaagggttacgggaacgtacgttaccgaaaaggccggtaaaaccgttcgggtacggccgtaaggcccaaacccgtatccgttacggttcctttacgtaacccg

SEQ ID NO: 367743 - DNA, 550 bp, Homo sapiens
  misc_feature: GZ8MTXP02GQJ27.19.57.F02.1.454.CMB.2.raw
  modified_base (537)..(537): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgctcgtaggctggtatcagcagaaagcaacggaaacccctaagctcctgatctagtggtgcatcccacgtttagggaaacggttcggggtcccctagtaaggttccagcggcaggtggatcgtgggacagtatttcactctcgcatcagcagctgacagactgaagtatttcgacttaactttattttgactaactacggtaccttaaacctacctttccccctctaacgtttcggacggtacgggacctaagggtggagactacgaacgacgaacctggtggaactgaccacctntacgtcgttctcg

SEQ ID NO: 367744 - DNA, 538 bp, Homo sapiens
  misc_feature: GZ8MTXP02GN03Y.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatcccactttgggaaaagtcggggtcccctgaaggttccagcggcaggtggatcgtggggacagtatttcactctcgcatcagcagcctgcagactagaagtatttgactaaactttatttttgtactaacagggtacctaaactacctttccccctactaactttcgggacggaacgggaccaagggtcggagactacgaaacgcgaaactgtggctcggcaccatctgtctttacc

SEQ ID NO: 367745 - DNA, 557 bp, Homo sapiens
  misc_feature: GZ8MTXP02GF2VE.19.57.F02.1.454.CMB.2.raw
  modified_base (297)..(297): a, c, t, g, unknown or other
  modified_base (547)..(547): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgtaggctggtatcagcaagaagcaacgggaaaccccaagctctgatctatggtncatcctagtttaggaaacggtcggggtcccctagtaaggttccagcggcaggtggatcgtgggacagtactttcgactctcgacatcgagcacgcctgacacgactagaagttatttcgacttaaacttttattttacgtactaaacgtagtacctaaacctaccctttcccctacgtacgtttcgggacggtacgggaacctaacggggtagaagtactacgaagcgtaacgtcggtggctcgctaacntctcgtctac

SEQ ID NO: 367746 - DNA, 548 bp, Homo sapiens
  misc_feature: GZ8MTXP02JE4N1.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatagttaggcgctcgttaggctggatcagcagaaagcaacgggaacccctaagctcctgatctatggtgctatccctacgtttggaaacgtcggggtcccctagtaacggttccgagcggcagtggatcgtgggacagtattcactctcgcatcagcagcctgacagactagaagtatttagactaactttatttagtactaactacgtacctaactacctttcccctactacgtttcggcggtaagggaccgtaagggtcggaagacgtacgaacgccgtaacgtcggtggaactcgaccactactctcgttctttacg

SEQ ID NO: 367747 - DNA, 578 bp, Homo sapiens
  misc_feature: GZ8MTXP02HM0ZP.19.57.F02.1.454.CMB.2.raw
  modified_base (197)..(197): a, c, t, g, unknown or other
  modified_base (407)..(407): a, c, t, g, unknown or other
  modified_base (423)..(423): a, c, t, g, unknown or other
  modified_base (463)..(463): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttgtcgggcgagtcaggatagttaggcgctcgttaggctggtatcagcagaaagcaacgggaaacccctaagctcctgatctatggtgcatccgtactttggaaagtcggggtcccctgtaaggttccagcgcaggtggacttcgtggggacagtattcactctcgcctatcagcagcctgcagctagaagtntttgacttaacgtttnttttgtacaactacggtaccttaacctccctttacccccngttaccgtttccgggacggtacgggaaccaaggggttagagtacgtaacgaacggtacgtaacgtcggttggaaccttaggaccctacccgtattcccgttagttacctttcccg

SEQ ID NO: 367748 - DNA, 535 bp, Homo sapiens
  misc_feature: GZ8MTXP02GNFST.19.57.F02.1.454.CMB.2.raw
  modified_base (197)..(197): a, c, t, g, unknown or other
  modified_base (285)..(285): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcggcagtcaggatattaggcgctcgttaggctggtatcagcagaaagcaggaaaccccctaagctccngatctatggtgcatccactttggaaagtcggggtcccctgaaggttccagcgcagtgatctgggacagatttcactctcgccatcagcagcctgcagactagaagtatttgactaactttattttgtacaacaggtacctaaacctacctttccccctctaacgtttccggacggtagggaccaacgggttggaagtacgtacgaaacgccgtaaacgtgtaggctcgacgaccagtcctcgttcttacg

SEQ ID NO: 367749 - DNA, 604 bp, Homo sapiens
  misc_feature: GZ8MTXP02FZJAR.19.57.F02.1.454.CMB.2.raw
  modified_base (299)..(299): a, c, t, g, unknown or other
  modified_base (328)..(328): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaacgggaaaccccctaagctctgatctatggtncatccactttggaaagtcggggtcccctnaaggttccagcgcaggtggatcgtgggacagtatttcactctcgccatcagcagcctgcagactgaagtatttgacttaactttatttttgacaaacgtacggtaccttaaacctacccttttccccctacttaaccgtttccgggaccgggtaaacggggtaacccgtaaaacggggttggaaacgtacgtaaccgaaacggaccgtaaaaccgtgggttaacgggccttacggaccctaacccgtaagtttccttacggttcccttttaacccg

SEQ ID NO: 367750 - DNA, 586 bp, Homo sapiens
  misc_feature: GZ8MTXP02IBVNR.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcaacgggaaacccctagctcctgatctatggtgcatccatttaggaaacgtcggggtcccctgaacggttccagcggcagtggatcgtgggacagtactttcactctcgccatcagcagcctgcagactagaagtatttgacttaacttttattttcgtacaactacggtaccttaaacctacctttaccccctcgtaccgttttccgggacgggtaacgggacccgtaaaggggttcggaagtaacttacgaaacggtaccgaaacgttggtacgggccttacggacctaccgtacttccgttacgtttcctttacccg

SEQ ID NO: 367751 - DNA, 557 bp, Homo sapiens
  misc_feature: GZ8MTXP02FP08C.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgctcgttaggctggtatcagcaagaaagcaacgggaacccctagctcctgatctatggtgcatccactttaggaaagtcggggtccctgaggttccagcgcagtggatcgtgggacagtatttcactctcgcatcagcagcctgacagactagaagtatttgactaactttattttgtactaactaggtacctaaacctacctttccccctactacgtttcgggacggacgggaccgtaaaagggtggacgtaagttaccgaaacggtccgtaaacgtggttcggcgtacggacctacctattcctacggttctttacc

SEQ ID NO: 367752 - DNA, 555 bp, Homo sapiens
  misc_feature: GZ8MTXP02IBQ4S.19.57.F02.1.454.CMB.2.raw
  modified_base (323)..(323): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcggcagtcaggatataggcgctcgtaggctggtatcagcagaaagcaagggaaacccctaagctcctgatctatggtgcatccactttggaaagtcggggtcccctnaaggttccagcggcaggtggatcgtggggactagacttttcgacttcctcgcccatcagcacgcctgacagactagaagtatttacgacttaaactttatttttaggttacaaactaggtacctaaacctacctttaccccctctaccgtttcggaccggaagggaaccctaagggtcggaggaactcgaaacgcgaaacgttcgtggctggactaccatctcgttacttcc

SEQ ID NO: 367753 - DNA, 538 bp, Homo sapiens
  misc_feature: GZ8MTXP02IR53E.19.57.F02.1.454.CMB.2.raw
  modified_base (378)..(378): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggatcagcagaaagcaagggaaaccccctaagctcctgatctatggtgcatccacgtttggaaagtcggggtcccctgaaggttccagcgcagtggatctggggacagattcactctcgccatcagacngcctgcagactagaagtatttgacttaactttattttcgtacaactaggtaccttaaacctaccttttccccctactaccgtttcgggacggtacggaccgtaagggtggaagactcgaaacgcgaactggtagcgttcgacacccatccttgtctttcc

SEQ ID NO: 367754 - DNA, 585 bp, Homo sapiens
  misc_feature: GZ8MTXP02HOBN6.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggatagttaggcgctcgttaggctggtatcagcagaaagcaacgggaaacccctaagctcctgatctatggtgcatcctacgtttggaaagtcggggtcccctagaaggttccaggcgcagtggatcgtggggacagtatttcactctcgcatcagcagcctgcagactagaatatttgacttaactttatttttacgtacaacgtaggtactaaacctacctttccccctactaccgtttcggacgggtacgggtaaccgaagggttacggaagtacgtaccgaaacggcgtaaaaccgtgggttacggaaccgttacggaccctaacccgatttccgttacgtttcgtttaaccc

SEQ ID NO: 367755 - DNA, 654 bp, Homo sapiens
  misc_feature: GZ8MTXP02GKH4C.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgctcgttaggctggtatcagcaagaaagcgaacgggaaacccctaagctcctgatctatggtgcatcctacgtttagggaaacggttcggggtcccctagtaacggttccaggcggcaggtggatcgtggggactaggtactttcactctcgccatcagcacgcctgacagactagaaacgtatttgacttaaacttttattttacgtacaaacgtacggtaccttaaacctacccttttacccccgtacttaacccggttttccggggaccggggtaaacggggtaacccgtaaaggggtcgggaaacgtaacgttaaccgaaacgggtaccgtaaaaccgttgggttaccgggtaaccgttaccggaacccgtaacccgtaactttcccgtttacggtttaccccttttacccg

SEQ ID NO: 367756 - DNA, 574 bp, Homo sapiens
  misc_feature: GZ8MTXP02I816S.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaagcaggaaacccctaagctcctgatctatggtgcatccacgttggaaacgtcggggtcccctagaaggttccagcgcagtggatcgtggggacagtattccactctcgccatcagcagcctgacagtactagaagtatttcgactaactttattttgtactaaacgacggtacctaaacctcctttacccctcgtaaccgtttcgggaccggtacgggaaccctaaagggttggaaacgtacgtaaccgaaaggtaccgaaaacgttcggtacgggaactcggacctaccgtattccgtacgtttcctttacc

SEQ ID NO: 367757 - DNA, 767 bp, Homo sapiens
  misc_feature: GZ8MTXP02IIAW2.19.57.F02.1.454.CMB.2.raw
  modified_base (244)..(244): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcnctcgttaggctggtatcagcaagaaagcgaacgggaaacccctaagctcctgactctatggtgcatccacgtttaggaaacgttcggggtccccctgtaaacggttcgaaggcggacacggttagggacgttcgtagggggaacctaaggtacttttaccaaccgtttaccgttcccggaccctaaacgttcccaaacgggtcccaacgggtacccccttgggacccgaaagggtaacccgttaaggaaaagggttaactttttacccggtaaacctttaaaacttttttaacgtttttttacggaacctaaaaccgtacggtaaacccttaaacccttaccctttttaacccccccttgttaaaccccggtttttccgggggacccgggttaaaacgggggaaaccccgtaaacggggttacgggggtaaaacgtaaccggttaaccggaaaaccggtaaccggtaaacggttcggttacggtaccgttaccggtaacctaacccgttacgttaccgtttcg

SEQ ID NO: 367758 - DNA, 547 bp, Homo sapiens
  misc_feature: GZ8MTXP02GO9A6.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatataggcgctcgttaggctggtatcagcagaaagcaacgggaaaccccctaagctcctgatctatggtgcatccactttaggaaagtcggggtcccctcgaaggttccagcggcaggtggatcgtggggacagtattcactctcgccatcagcacgctgcagactagaagtatttgacttaaactttagtttttagtacaaactaggtaccttaaacctacccttttaccccctctaccgtttcgggacgggtaacgggaaccgaagggtcggagactacgaaagcgaacgtgtaggctgccacatctcgtcttacc

SEQ ID NO: 367759 - DNA, 543 bp, Homo sapiens
  misc_feature: GZ8MTXP02HOSOG.19.57.F02.1.454.CMB.2.raw
  modified_base (327)..(327): a, c, t, g, unknown or other
  modified_base (370)..(370): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatagttaggcgctcgttaggctggtatcagcagaaagcaagggaaacccctaagctcctgatctatggtgcatcctactttggaaagtggggtcccctnaaggttccagcggcagtggattcgtgggactagatttcactcncgcatcagcagcctgcagactgtaagtattttgactaaactttatttttcgtactaactaggtacttaaacctacctttaccccctctaccgtttcggacgggtaacgggaacctaagggtagacggactacgaaacgcgaacttggtggaacgtgaccacatctcgttcttc

SEQ ID NO: 367760 - DNA, 602 bp, Homo sapiens
  misc_feature: GZ8MTXP02GUJR3.19.57.F02.1.454.CMB.2.raw
  modified_base (197)..(197): a, c, t, g, unknown or other
  modified_base (410)..(410): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggattattaggcgctcgttaggctggtatcagcagaaagcaagggaaacccctaagctcctgatctatggtgcatcctacgtttgggaaagttcggggtcccctcgtaaggttccagcggcagtggatcgtggggactagtactttcactctcgccatcagcagcctgacacgactgaagtntttgacttaaactttattttgtactaacacggtactaacctacctttaccccctactaacgtttccgggacgggtaacgggaacccgtaaaggggttcggaagtaacgtacgaaaacggtccggtaaaacgtcggtacggggtccttacggaccctaacccgtaagttacccttacggtttccttttacccg

SEQ ID NO: 367761 - DNA, 580 bp, Homo sapiens
  misc_feature: GZ8MTXP02H4EBR.19.57.F02.1.454.CMB.2.raw
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtaggctggatcagcagaaagcacgggaaacccctaagctcctgatctatggtgcatcctagtttaggaaagtcggggtcccctagaaggttccagcggcaggtggatctggggactagtatttcgacttctcgccatcagcagccctgacagactagaagtatttagacttaaacgttttatttttacgtactaaacgtaggtaccttaaaccttaccctttcccccttactaccgtttccgggacggtacgggaaccgtaagggtacgggaagtactaccgaaaggaccgtaacgtggtcggtctacggacctacccattccgtacgtttacttccg

SEQ ID NO: 367762 - DNA, 579 bp, Homo sapiens
  misc_feature: GZ8MTXP02JX04E.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaggatagttaggcgctcggttaggctggtatcagcagaaagcgaacgggaaaccccctaagctcctgatctatggtgctactcctacgtttgggaaacgttcggggtacccctagtaacggttccaggcggcagtggatcgtggggacaggtacttcactctcgccatcagcacgcctgcacgactagtaagtatttgactaactttattttagtacaacgtacggtacctaacctaccctttacccctacgtaccgtttcggacggtacgggaaccgtaagggtcggagacgtacgaacggcgtaaacgtcggtggtcgtcggacctacctatccgttcgttactttaccg

SEQ ID NO: 367763 - DNA, 587 bp, Homo sapiens
  misc_feature: GZ8MTXP02HX1KB.19.57.F02.1.454.CMB.2.raw
  modified_base (196)..(196): a, c, t, g, unknown or other
  modified_base (423)..(423): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaganacagagtcaccatcacttggtcgggcgagtcaggattattaggcgtcgtcgttaggctggtatcagcaagaaagcgaacggaaaccccctaagcctcctgatctatggtgcactcctagtttaggaaaggtcggggtcccctagaacggttccaggcggcgaggtggatcgtgggacagtactttcactctcgccatcagcacgccctgacaacgactagaaagttnttttagacttaaacttttattttacgtacaaacgtacgtaccttaactaccctttccccctagtaaccgtttccgggacgggaacggtaaccctaagggtcggaagtactacgaaacggtacgaacgttggtacgcgtcgacctactacttcgtcgttcctacc

SEQ ID NO: 367764 - DNA, 600 bp, Homo sapiens
  misc_feature: GZ8MTXP02JF9CG.19.57.F02.1.454.CMB.2.raw
  modified_base (301)..(301): a, c, t, g, unknown or other
tcagtactctcgtgcacgaccggtgctcgatttagctcgatatagttgggtttggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaaggaaaccccctaagctcctgatctatggtncatccactttggaaagtcggggtcccctacgaaggttaagcggcagtggatcgtgggacagatttcactctcgccatcagcagcctgcagactgaaagtattttagctaaactttatttttgtactaaacgtacggtactaaacctaccttttcccccctactaaccgttttccgggacgggtaacggggaacccgtaaaggggttacgggaaacgtaacgttaccgaaacggaccggtaaacgttaggttaacggggaccttacgggacctaaccccgtaacgtttccttggtttccg

SEQ ID NO: 367765 - DNA, 545 bp, Homo sapiens
  misc_feature: GZ8MTXP02GV1RY.19.57.F02.1.454.CMB.2.raw
  modified_base (201)..(201): a, c, t, g, unknown or other
  modified_base (302)..(302): a, c, t, g, unknown or other
  modified_base (351)..(351): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgctcgtaggctggtatcagcagaaagcaacgggaaacccctaagctcctgatctatggtncatcctagtttaggaaagtcggggtccctacgaaggttcagcgcagtgntcgtgggacagtattcactctcgcatcagcagctgcaagactagaagttatttgacttaacttttattttagtacaaactacgtacttaaacctacctttccccctactacgtttcgggacggtacggaccgtaaagggtcggagtactacgaaacgtcggtaaactggtacgctacggaccactacgtcttcg

SEQ ID NO: 367766 - DNA, 597 bp, Homo sapiens
  misc_feature: GZ8MTXP02G9X5H.19.57.F02.1.454.CMB.2.raw
  modified_base (361)..(361): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgctcgtaggctggtatcagcaagaaagcgacggaacccctagctcctgatctagtgtcgcactccgtagtttaggaaacgtcggggtacccctagtaaggtccaggcgacgaggtgatcgngggacagtacttcactctcgccatcagcacgccgtgacacgactaggtaaacttacgtttcgtaactttaaacttttattttacggactaacgtacgtaccttaaccttaccctttccccctacgttaccgttaccgggacgggtaacgggtaccgtaagggtacggagtaacgtacgaaacggtaccgtaacgtggtcgcgtacggacctaccgtactccgttcgttacttaccg

SEQ ID NO: 367767 - DNA, 585 bp, Homo sapiens
  misc_feature: GZ8MTXP02G5NZP.19.57.F02.1.454.CMB.2.raw
  modified_base (297)..(297): a, c, t, g, unknown or other
  modified_base (378)..(378): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatagttaggcgctcgttaggctggtatcagcagaagcgaacggaacccctaagctcctgatctatggngcactcctacgtttgggaaacgtcggggtcccctagtaaggttccaggcgcaggtggattcgtggggacagtattcactcncgccatcagcacgcctgacagactagaagttatttacgacttaacgtttattttgactaacgtaggtacctaacctaccctttcccctacgtaccgtttcgggacggtacgggtaccgtaaggggtcgaacgtacgtacgaaacggaccgtaaacgtggttacggccttacgacccgtacgtacgttaccgttacgttcctttaccg

SEQ ID NO: 367768 - DNA, 575 bp, Homo sapiens
  misc_feature: GZ8MTXP02J1TBT.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcaagaaagcaacgggaaaccccctagctcctgatctatggtgcatccactttggaaagtcggggtcccctgaaggttccagcggcagtggatcgtgggacagtattcactctcgccatcagcagcctgcagactagaagtatttagacttaactttattttcgtactaacgtacggtaccttaaacctacccttttaccccctacgttaaccgtttccgggaccgggtaacgggtaaccgtaacggggtggaagtacgttacgaaacggaccgaacgttggtacggtcgtcggaccacactccgtcgtcctttccg

SEQ ID NO: 367769 - DNA, 586 bp, Homo sapiens
  misc_feature: GZ8MTXP02FU4G4.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgctcgttaggctggtatcagcagaaagcaacgggaaaccccctaagctcctgatctatggtgcatcccacgtttgggaaaggtcggggtcccctacgaaggttccagcggcaggtggatcgtggggacagtatttcactctcgcatcagctagcctgcagactagaatatttgacttaactttattttcgtactaaacgaggtacctaaacctacccttttaccccctcgttaccgtttccgggacgggtaacggggacccgtaaaggggtacggtaacgacgttaacgaaacggaccgtaaacgtggttacgggcttcggactaccgtattcgtcgtcctttacc

SEQ ID NO: 367770 - DNA, 550 bp, Homo sapiens
  misc_feature: GZ8MTXP02GCQS7.19.57.F02.1.454.CMB.2.raw
  modified_base (304)..(304): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatattaggcgctcgttaggctggtatcagcaagaaagcaacgggaaaccccctaagctacctgatctatggtncatccagtttggaaacgtcggggtccctgaaggttccagcggcaggtggatcgtggggactagtatttccatctcgcatcagcagcctgacagactagtaagtatttacgacttaactttattttcgtactaactacggtactaaacctacctttacccctactacgtttcggacggagggtacctaagggtcgaagtactacgaacgacgaacgtgtcggctcgacacgattcgtacgttcttac

SEQ ID NO: 367771 - DNA, 592 bp, Homo sapiens
  misc_feature: GZ8MTXP02G448R.19.57.F02.1.454.CMB.2.raw
  modified_base (305)..(305): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaaggatattaggcgctcgttaggctggtatcagcaagaaagcgaacgggaaaccccctaagcctcctgatctatggtncatcctacgtttggaaacgtcggggtcccctagtaaggttccagcggcaggtggatcgtggggacagtactttcactctcgccatcagcagcctgcagactagaagtatttgactaacttttattttagactaaagtacggtaccttaaacccttacccttttaccccctacgtaaccggtttcgggaccgggtaacgggaaccgtaaagggtcggaaagtacgtacgaaacggtacggaaacgtggtacggctacggacctaacctattcgtacgttcctttaccg

SEQ ID NO: 367772 - DNA, 566 bp, Homo sapiens
  misc_feature: GZ8MTXP02JR5KQ.19.57.F02.1.454.CMB.2.raw
  modified_base (376)..(376): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgtgacatccagatgacccagtctccatcttccgtgtctgcatctgtaggagacagagtcaccatcacttgcgggcagtcaggatattaggcgctcgtaggctggtatcagcagaaagcaacgggaaacccctagctcctgatctatggtgcatcctagtttaggaaagtcggggtacccctacgaacggttcagcggcaggtggatcgtgggacagtattcactcncgcatcagcagctgcagactagaagtatttgacttaactttattttcgacaacgtagtaccttaaacctacccttttccccctacttaccgtttcggggacgggtaacggggaaccgtaaaggggtcggaaagtacgtacgaaaacggtcgaaacgtggtacggacgtacggacctaccgtactcgttcg

SEQ ID NO: 367773 - DNA, 674 bp, Homo sapiens
  misc_feature: GZ8MTXP02H16NS.19.57.F02.1.454.CMB.2.raw
tcagtactctcgtgcacgaccggtgctcgatttagctcgatatagttgggtttggggagtcagacccagtcaggacacagcatggacatgagggtcccccgctcagctcctggggctcctgctgctctggttcccaggttccagatgcgacatccagatgacccagtctccatcttcgtgtctgcatctgtaggagacagagtcaccatcacttgtcgggcgagtcaggatagtaggcgtctcggttaggctggtactcagacaagaaagcgaaacgggaaacccctagctacctgtactcgtagtggtcgactaacttccgtaacgttttagggaaaacggttccggggtacccctagaaacggttcccgaggccggacaggttaggacttcgtcggggaactaaggtactttaccacgttcgtcgaccatacgaggctacgcccgtagacgaacgactagtaaagttgttttacgacctttaaattttagtttttacgtaactaaacgtacggtacccttaaaccgttaaccccctttcccccgttacgttaccgtttacccgggacgggtaacgggtaaacccgttaaggggttacgacggtaaactacggaaacgaccggtaacgtgggtacgccgtcggaacctaccgtatttccgtacgtttactccg

SEQ ID NO: 367774 - DNA, 805 bp, Homo sapiens
  misc_feature: GZ8MTXP02H3UIQ.19.57.F02.1.454.CMB.2.raw
tcagtactctcgtgcacgaccggtgctcgatttagctcgatatagttgggtttggggagtcagacccagtcaggacacagcatggacatgagggtcccccgctcagctcctggggctcctgctgctctggttcccaggttccagatgcgacatccagatgacccagtctccatcttccgtgtctgcatctgtaggagacagagtcaccatcacgttggtcgggcgagtcgagggtattagttaggcgtctcggttaggctggtatcagacaagaaagcgaacgggaaacccctagctacctgactctagtaggtcgctacttccgtaacgttttagggaaacggttccggggttaccccctaggtaaacggttcccgaacgggtccggtactaagggttgggaacgtttccggtagggggaaaccttaaaggttaccgtttttacccaacgtttccccggtccgacccctattacccgaacggtccctaaacgggtccccgtacgtaccgtaaacggtaaccgttaaggttaaacgtttacgttttaacgtaaaccttttaaacgtttttaacgtttttaacgtaaacgtaaacgttaaccggttaaccctttaaaccgtttacccccgtttaccccgtttaccggttaccgggtttaccggggtaaccggggtaaccgggtaaaccggttaacggggtaacgggtaaacgtaacgttaaaccggaaacggtaccggtaacgttcgggtaccggtccgtacggtaacccgtaccgttacgtttcccgttacgtttaccttacccg

SEQ ID NO: 367775 - DNA, 757 bp, Homo sapiens
  misc_feature: GZ8MTXP02GWZ9X.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtccaccatcacttggcggcagtcaggatagttaggcgctcgtaggctggtatcagcaagaagcgaacggaaacccctagcctcctgactcgtagtggtgactacttacccgtaacgtttacgggaaaacggttccgggggtacccctaacgtaacggggttccccgaacgggccgggtacgtaacgggttcggggaaacgttccggtagggggtaaacctaagggtttaacgttttacccgaaaccctttcccgtacccggaccctaaacgttacccgaaacggtaccgaaaccgggtcccccttaggaccgtaaaaccggtaacgttaaggtaaaaggtttacttttacgtaaacctttaaaactttttagtttttacggtaaacctaaacgtaaacggtacccttaaaaccttacccctttaccccgtacgttaccgtttaccggggacggtaacgggtaaccgtaaaggggttacggaaagtacgtaacgaaacggtaccgtaaacgtcggaacggtctacgaccaccgtaagtccttacgttctttaccg

SEQ ID NO: 367776 - DNA, 570 bp, Homo sapiens
  misc_feature: GZ8MTXP02JMKZD.19.57.F02.1.454.CMB.2.raw
  modified_base (462)..(462): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatataggcgctcgttaggctggtatcagcagaaagcaacgggaaacccctaagctcctgatctatggtgcatcctagtttaggaaagtcggggtcccctagaaggttccagcggcaggtgatcgtggggacagtatttcactctcgccatcagcagcctgacagactagaagtatttgacttaaacttttattttgtaccaacgtacggtaccttaacctacctttaccccctntaccgtttccggacgggtacgggacccgtaaagggttcggaagtacgtacggaaacgtccgtaaacgtggtcggaacgttcggaccaacgtctcggttacttcttacc

SEQ ID NO: 367777 - DNA, 606 bp, Homo sapiens
  misc_feature: GZ8MTXP02G7KJ6.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcgagtcaggtatattaggcgctcgttaggctggtatcagcagaaagcgaacggaaacccctagctcctgatctatggtgctatcctagttaggaaacgtcggggtcccctagtaaggttcccagcgcaggtggactcgtggggactagtactttcgactctccgcatcagcacgcctgacagactagaagttatttacgacttaactttagttttagactaaacgtaggtaccttaacctaccctttcccctacgttaccgtttccgggacgggtaacgggtaccgtaaagggtcggtaacgtaacgtacgaaacgtaccggtaaacgttcggtacggtaaccgtacggaccctaaccgtacttaccgttacggttcctttacccg

SEQ ID NO: 367778 - DNA, 706 bp, Homo sapiens
  misc_feature: GZ8MTXP02H67QM.19.57.F02.1.454.CMB.2.raw
  modified_base (301)..(301): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcgaggtatagttaggcgtctcgttaggctggtatcagcagaagcgaacggaaacccctagctcctgatcagtggtnctatcctacgtttaggaaacggtccggggtcccctagtaaggttccgaggcggacgaggtggacgttcgtggggaactaggtactttccgacttccgtacgccactcgagccgacgccctagacgtaagacgttaaggtaaacgtttacgtttacgtaacctttaaaccgttttttagtttttaccggtaaacctaaacgtaacgggttaacccttaaacccttacccccttttccccccgttacgttaacccggttttaccgggggaacggggttaaaccggggaacccgttaaaagggggtcgggtaaacggtacttaccggaaaacggtaccgtaaacggttcggtacggtaacctacggtaaccctacccgtatttacccgtttcggttaaccctttcccg

SEQ ID NO: 367779 - DNA, 584 bp, Homo sapiens
  misc_feature: GZ8MTXP02HSGOZ.19.57.F02.1.454.CMB.2.raw
  modified_base (328)..(328): a, c, t, g, unknown or other
  modified_base (361)..(361): a, c, t, g, unknown or other
  modified_base (374)..(374): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacttgtcgggcgagtcaggatattaggcgctcgttaggctggtatcagcagaaagcacgggaaaccccctaagctcctgatctatggtgcatccagtttggaaagtggggtacccctntaacggttccaggcggcagtggatcgtgggganagtatttcactcncgccatcagcagcctgacagactgaagtattttcgacttaaactttatttttcgtactaaacgtaggtaccttaaacctacccttttccccctactaaccgtttccgggacgggtagggaaccctaaggggtggtaaggactacgaaacgccggtaaacgtcgggttcggccttcggacctaaccgtactttccgtcggtttctttaccg

SEQ ID NO: 367780 - DNA, 612 bp, Homo sapiens
  misc_feature: GZ8MTXP02JM2XW.19.57.F02.1.454.CMB.2.raw
  modified_base (303)..(303): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcgagtcaggtattagttaggcgtctcgttaggctggtatcagcaagaagcgaacgggaacccctagctctgatctagtggtncatccctagtttagggaaacggtcggggtcccctagtaaggttccaggcgcaggtggattcgtggggactagtactttcactctcgccatcagcagcctgacagactagaagtatttcgacttaacttttattttacgactaaacgtacggtaccttaaaccttaccctttaccccctacgttaaccggtttccggggaccgggtaacggggaacccgtaaggggttacggaaacgtacgtaccgaaaggtccggaaacgttggtacgggtcctacggacctaaccgtacttacgttcgttctttaccg

SEQ ID NO: 367781 - DNA, 541 bp, Homo sapiens
  misc_feature: GZ8MTXP02HKX09.19.57.F02.1.454.CMB.2.raw
  modified_base (298)..(298): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaacgggaaacccctaagctcctgatctatgtncatccatttggaaagtgggtccctgaagtcagcgcagtggatcgtgggacagatttcactctcgcatcagcagcctgcagactgaagtatttgacttaaactttattttacgtacaaacgtacgtaacttacctaacctttccccctataccgttttcgggacggtaacgggaccgtaagggtcgggacgtaatacgaaagacgtaacgttggtacggaactcggacaccatctcgttcttac

SEQ ID NO: 367782 - DNA, 656 bp, Homo sapiens
  misc_feature: GZ8MTXP02GK3L1.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcaggtatagttaggcgctcgttaggctggtatcagcagaaagcgaacggaaaccccctaagctcctgatctagtggtgcattcctacgtttagggaaacggttcggggtacccctacgtaaggttccgaggccggcgaggtggacttcgtgggggaactaggtactttccgacctcgtaccgcctaatcgaacgcacgcctgacagtacgtagaaagttagtttagtacttaaacttttagtttttcgtaactaacgtacgggtaaccttaaaccttacccctttacccccgtacgtttaacccgtttcgggaccggggtaacgggtaacccgtaaggggttacggaagtactaacgaaacggtacgtaaacgtcggttaaggccgtacggtacctaaaccgtactttccgttacgtttcctttaccg

SEQ ID NO: 367783 - DNA, 547 bp, Homo sapiens
  misc_feature: GZ8MTXP02FKMG2.19.57.F02.1.454.CMB.2.raw
  modified_base (377)..(377): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcggcagtcaggatagttaggcgctcgttaggctggtatcagcagaaagcgaacgggaaaccccctaagcctcctgatctatggtgcatccactttgggaaagtcggggtcccctagtaaggttccagcggcaggtggatcgtgggacagtatttcactcncgccatcagcagcctgacagactagaagtatttgactaactttatttttacgacaactaggtactaacctacctttaccccctctaccgtttcgggacggagggaaccgaaggttcggagactacgaagccgtaacgtgtacgcgtgaccaccgattcctcgttcttacc

SEQ ID NO: 367784 - DNA, 576 bp, Homo sapiens
  misc_feature: GZ8MTXP02GU8AZ.19.57.F02.1.454.CMB.2.raw
  modified_base (223)..(223): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggngagtcaggatattaggcgctcgttaggctggtatcagcaagaaagcaacgggaaaccccctaagcctcctgatctatggtgcatccacgtttgggaaacgtcggggtcccctacgtaaggttccgagcggacaggtggacgttcgtggggacaggtatttcactctcgtccatcagcagcctgacagactgtaaagtactttgacttaaactttattttacgactaacgacgtacctaaaacctccctttcccctactaccgtttcggacggtacggggtaaccaaacggggtggaagtactaaccgaaagtccgaaacgtggtacgcgtcgacacctatctacgtctttacc

SEQ ID NO: 367785 - DNA, 652 bp, Homo sapiens
  misc_feature: GZ8MTXP02HMBTY.19.57.F02.1.454.CMB.2.raw
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccactcagctcctggggctcctgctgctctggttcccaggttccagatgcgacatccagatgacccagtctccatcttccgtgtctgcatctgtaggagacagagtcaccatcacttgcgggcagtcaggatattaggcgctcggttaggctggtacncgagacaaaggaacgacggaaacccgggaaacccctagcctacgtagtactcgtagtggtacactactaccgttacggttagggaaacgggtcccgggttaccctaggtacggtccgacggcgacgtaggtagtacgttcggaggggactaagttacttccacgttccgccgacatcgacgcgacgtccgtacgacgacgtacgtaagtaaacgtttgttacgtaacctttaagtttttattttacggtaacaacggtacgtaaccttaacccgttacccctttccctacgttacggttccgggacggggtaacggtaaccgtagggtacggagtaactacgaacgtacgtaacgttgacggtcgacgacctaacgtcttcgttactttccttacg

SEQ ID NO: 367786 - DNA, 627 bp, Homo sapiens
  misc_feature: GZ8MTXP02ITSGX.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcaggaacccctaagctctgatctatgtgcatcctagtttggaaagtcggggtcccctagaggttccagcgcagtggatcgtggggactagtactttcacctctcgccatcagcacgcctgacagactagaaagtatttacgacttaaacttttatttttacggtacctaaacgtacgggtaccttaaacccttcccttttaccccctacgttaccgttttccggggaccgggtaacggggaacccgtaaaggggtcggaaacggtacgttaaccggaaacggtaccggtaaaaccgttcgggttacggtccgttacggacccgtaacccgtaactttccgttacggtttccttttaacccg

SEQ ID NO: 367787 - DNA, 728 bp, Homo sapiens
  misc_feature: GZ8MTXP02IUTS0.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgtaggctggtatcagcagaaagcaacgggaacccctaagctcctgatctatggtgcactccgtaacgtttgggaaacggttcggggttaccccctagtaaacgggtttcccgaacggccggcgtaagggttgggaacgtttccgtcgggggtaacctaagggtaactttttaccaacccgttccgtaccgggaccctaatccgaacggcctaaacggcccttaggacctaaggtaacctttaggaaaagttagtttttacggaacctttaaactttttaagtttttacggtactaaaaccgtacgggtaacccttaaaccgttaccccgttttaccccccttacgtaaacccgtttttccggggaaccggggtaacggggtaacccgtaaaagggggttacggaacgtaacgtaccggaaaaggtccgtaaaacgttcggtacgggtcctacggacctaaccgtattccttacggttacctttaccg

SEQ ID NO: 367788 - DNA, 551 bp, Homo sapiens
  misc_feature: GZ8MTXP02JJG6C.19.57.F02.1.454.CMB.2.raw
  modified_base (196)..(196): a, c, t, g, unknown or other
  modified_base (392)..(392): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatagttaggcgctcgttaggctggtatcagcagaaagcaggaaacccctaagctcctgatctatggtgcatccctacgtttgggaaacgtcggggtcccctacgtaacggttccgaggtcgggcaaggtggaagtcgtgggggactaggtatttcgactcgtcncatcagcagcctgcagactgaagatttgactaaactttatttttgtactaactaggtactaaacctacctttaccccctataccgtttcggacgggtagggaacctaagggtcggagtacgacgaacgcgtaaacgtgtggctgacacatctcgtcttc

SEQ ID NO: 367789 - DNA, 680 bp, Homo sapiens
  misc_feature: GZ8MTXP02I9WX7.19.57.F02.1.454.CMB.2.raw
  modified_base (198)..(198): a, c, t, g, unknown or other
  modified_base (499)..(499): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccatcttccgtgtctgcatctgtagganacagacgtcaccatcacgttggcgggcagtcaaggtattagttagggccgtcgtcggttaggcgttaggtatcgagacgaagaaacgaccgaacgggaaacccctaagccttcctagactctagtggtcacattaccctagtttacgggaaacggttccggggtaccccctagtaacggttcccgaacggtcggcgtagtggacttcgtggggactaggtactttacaccgttctccgactagtcacgacacgcccgtgacgacgtacgtagtaaagttgtttacgtacttaaagtttttnttttacggactaaacgtacggttaccctaaccttacccgttttccccacgtttaccggttccgggaacgggtaacgggaaacccgtaacggggtaggaaactacggtaacgaaacgggtcgtaaaccggttggaacggtctacggaacctaacccgttagtttccgtacgttacccttacg

SEQ ID NO: 367790 - DNA, 709 bp, Homo sapiens
  misc_feature: GZ8MTXP02JYZGF.19.57.F02.1.454.CMB.2.raw
  modified_base (447)..(447): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcgaaggtattagttagggctcgttcggttaggcttggtatcgagcaaggaaacgcgaaccgggaaaccccctagcctcctagactctagtggtcgactactccctagtttacgggtaaacggtccggggtacccctaggtaacggttcgacgggcgcgtaggtgacgtcggtagggactaagttacttcactccgtaccgcatacgacgcgacgtcccgngacgacgtaacgttaagtaacgtttacgtttacgtaaacttttaacgtttttactttacgacctaacggttaaccgttaaccctttaaaccccgtttcccccttttacccccgtacgtttaccgggttccgggggaaccgggggtaaacggtaaaccggtaaggggtacggtaacgtaacgtaacgaaaccggacgttaaccggttgggtaccggtccgtaccgaccgtaaccgttacgttccgtttacgtttaccttaccg

SEQ ID NO: 367791 - DNA, 597 bp, Homo sapiens
  misc_feature: GZ8MTXP02IW91I.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatattaggcgctcgttaggctggtatcagcagaaagcaagggaaacccctaagctcctgatctatggtgcatcctacgtttaggaaacgtcggggtcccctgaaggttccagcggcaggtgagtctggggacagtacttcgactctcgccatcagcacgctgacagacgtagaaagttatttgacttaaacttttattttcgttaccaaacgtacggtaccttaaaccttccctttacccctacgtaaccgttttccgggaccgggtaacgggaacccgtaagggtggaacggtacgttaacgaacggtaccgtaaacgtcgtacgggtcgtcggacgtacctaacttcgttaccgttccgtttaccg

SEQ ID NO: 367792 - DNA, 589 bp, Homo sapiens
  misc_feature: GZ8MTXP02HUXWH.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctcatcttccgtgtctgcatctgtaggagacagagtcaccatcactttggtcgggcgagtcaggatattaggcgctcgttaggctggtatcagcaagaaagcgaacgggaaacccctaagcctcctgatctatggtgctatctaactttgggaaagtcggggtacccctgtaacggttccagcgcaggtggatcgtggggacagtatttccactctcgccatcagcagcctgacagactagaagtatttagacttaaacttttagtttttagtactaaactaggtacctaaacctacctttcccccctagttaccgtttacgggacgggtaacgggtaccgtaaagggtaggtaagacgttaccgaaaggacgtaaaccgtgtacgggtctagaccacctataccgttcgtttacctttccg

SEQ ID NO: 367793 - DNA, 635 bp, Homo sapiens
  misc_feature: GZ8MTXP02ICREX.19.57.F02.1.454.CMB.2.raw
  modified_base (198)..(198): a, c, t, g, unknown or other
  modified_base (434)..(434): a, c, t, g, unknown or other
  modified_base (452)..(452): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctggtagganacagagtcaccatcacttggtcgggcgagtcaggatattaggcgctcgttaggctggtatcagcaagaaacgcgaacgggaaaccccctaagctcctgatctatggtgcatccctaacgtttagggaaacggttccggggtaccccctagtaacggtttccagccggactaggtggattcgtggggactagtactttcactctcgccatcagcagccgtgcacgactagtaagttntttgacttaaactttttnttttacgtacaaacgtacggtaaccttaaccttaccctttaccccctcgttaaccgttttccggggacggtaacggggaaccctaaaaggggtcggtaaagtacgttaccgaaacggtaccgaacgtttcgggacggtaacgtcggaccctaaccgttacgttccgtttacgttaccttaccg

SEQ ID NO: 367794 - DNA, 646 bp, Homo sapiens
  misc_feature: GZ8MTXP02HEL3R.19.57.F02.1.454.CMB.2.raw
  modified_base (369)..(369): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcagggtatagttaggcgcgtcgttaggctggtatcagcaagaacgcgaacgggaaaccccctaagcctcctgatctatggtgcatcctacgttaggaaacggtcggggtccctagaggttccgagcggacaggtggagtcgnggggactagtactttcacttcacgccatcacgcgacgccgtagcacgactaggtaaagttagttttacgacttaaacgtttttagttttcggtaacctaacgtaacggtacccttaaaccctaccccttttaccccctacgttaccggttttccggggaccggggtacggggtaacccgtaaaggggtacggtaacggtaacgtaccggtaaacggaccgtaaacgtcggtaacggtccgttcggacctacgtacttccgttacggttcctttaccg

SEQ ID NO: 367795 - DNA, 807 bp, Homo sapiens
  misc_feature: GZ8MTXP02HBKDT.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcagtcaggatagtaggcgctcgttaggctggtatcagcaagaaagcaacgggaaacccctaagctcctagatctagtggtgcatccctaacgttttagggaaaacggttcgggggtaccccctacgtaaacgggtttcccaacgggcggggtacgaaggttgggaacgttacggtacgggggaacctaaaggtaactttttaccgaaaccttccgtttacccgtaccccaaacttcccgaaacgggtcccaacggtacccccgttgggacccgtaaagggaacccgttaaggtaaaacgggttaatttttttacggaaacccgtttaaaacttttttaaagtttttttacggttaaaccgaaaaccgtaaacggggtaacctttaaaacccgttaacccctttttacccccccttcgtaaaccccgtttttaccggggaccgggggtaaaacggggtaaacccgaaaacgggggtttacgggaaaggtaactaaaccggtaaaacggaccggtaaaaccggttggtacgggggttaaccgtacggtacccgaaacccgtaagtttaccttacggtttcctttaaccc

SEQ ID NO: 367796 - DNA, 661 bp, Homo sapiens
  misc_feature: GZ8MTXP02G017P.19.57.F02.1.454.CMB.2.raw
  modified_base (197)..(197): a, c, t, g, unknown or other
  modified_base (304)..(304): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcgggcgagtcaggtatagttaggcgtctcggttaggctggtatcagcaagaagcgaacggaacccctagctctgatctagtggtnctactcccgtacgtttagggaaacggtccggggtcccctagtaacggttccaggcgcgaggtggactcgtggggactagtcttacacttcgcgactatcagctacgcctagcagtactagtaagttacttttgactttaacttttattttcgactaaacgtacggtaaccttaaaccttacccctttccccctacgttaccggtttccgggaaccggggtaacggggaaacccgttaaaggggtcgggaaacgtaacgttaccggaaaacggtccggtaaaacggtttcgggtaccggtaaccgttacggaacccgttaaaccgtactttcccgtttacggtttacccttttacccg

SEQ ID NO: 367797 - DNA, 613 bp, Homo sapiens
  misc_feature: GZ8MTXP02H20N0.19.57.F02.1.454.CMB.2.raw
  modified_base (197)..(197): a, c, t, g, unknown or other
  modified_base (298)..(298): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatcaccatcacttgtcgggcagtcaggatataggcgtctcgtaggctggtatcagcaagaagacgacgggaaaccccctagctcctgatctagtggncactcctagtttaggaaacggtcggggtcccctagtaaggttccaggccggcaggtgagtcgtggggactagtacttcactctcgcatcgagcagccctgaccagactagtaaacgttatttacgacttaaattttatttttacggtacctaaacgtacgtacccttaaacctccctttaccccctacgttaccggtttccgggacgggtacggtaaccggtaagggttacggaacgtacgttacgaaaacggtccgtaaaccgttgtacggtaaccgtacgaccttaccgtagttacctttcgttacctttccg

SEQ ID NO: 367798 - DNA, 572 bp, Homo sapiens
  misc_feature: GZ8MTXP02G0P11.19.57.F02.1.454.CMB.2.raw
  modified_base (325)..(325): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatagtaggcgctcgttaggctggtatcagcaagaaagcaacgggaaacccctaagctcctgatctatgtgcatccacttggaaacgtcgggtccccngtatcgtcagcgcagtggatcgtgggactaggtattcgactcgtcgtccatcacgcagccgtgacagacgtagtaagtagttttagaccttaaatttatttttagacctaacgtaacgtacttaacctaccctttcccctacgtaccgtttaccgggcgggtaacggtaccgtaaggtgggaacagtacgaacggacgtaaaccgtggtcggtactacggacctaccgtactccggttacgtttccc

SEQ ID NO: 367799 - DNA, 711 bp, Homo sapiens
  misc_feature: GZ8MTXP02I1PZF.19.57.F02.1.454.CMB.2.raw
  modified_base (197)..(197): a, c, t, g, unknown or other
  modified_base (683)..(683): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacatcacttggtcgggcagtcaggtatagttaggcgctcggttaggctggtatcagcaagaaagcgaacgggaaacccctaagcctcctgactcgtagtggtgctctaccgtacgtttagggaaacggtccggggttcccctacggtaacggttcccgaggccggacgtagggtcggaacttcggtggggaactagttactttccgacttcgccgaccagtaccaggaccacgcctagacaacggtacttaggtaaacgttagttttacgaactttaaacgtttttacgttttacgtaccgtaaacgtaacgggtaacccttaaaaccgttaccccttttacccccgttacgttaccggtttaccggggaacgggtaacggggtaaacccgtaaggggtacgggtaaacgtaacgtaaccggtaaacggtaccggtaaacgttcgggtaacggtccgttacggacctaaacccggttnttacccgtttacgtttccgtttaacccg

SEQ ID NO: 367800 - DNA, 550 bp, Homo sapiens
  misc_feature: GZ8MTXP02JJPKD.19.57.F02.1.454.CMB.2.raw
  modified_base (301)..(301): a, c, t, g, unknown or other
  modified_base (417)..(417): a, c, t, g, unknown or other
  modified_base (430)..(430): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgctcgttaggctggtatcagcagaaagcacgggaaacccctaagctcctgatctatggtncatccacgtttaggaaacggtcggggtacccctgtaaggttccaggcggctaggtggactcgtggggacagtactttcactctcgccatcagctacgctgcagctagatagtttanacttacttatttnacaacgagtactaactaccctttccctctacgtttcgggacggtacggaccgtaagggtggacgacgtacgaacggacgtaacgtggtacggctcggactacctacttccgtcgttctcg

SEQ ID NO: 367801 - DNA, 620 bp, Homo sapiens
  misc_feature: GZ8MTXP02GTPR2.19.57.F02.1.454.CMB.2.raw
  modified_base (201)..(201): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcagggatattaggcgctcgttaggctggtatcagcagaaagcaacgggaaaccccctaagctcctgatctatggtgcatcctacgtttaggaaacggtcggggttccctacgtaacggttcaggcggcaggttggagtcgtagggactagtatttcactctcgccatcagcagcctgacagactgaagtattttgacttaacttttagttttcgtactaactaacggtaccttaaaccttacctttaccccctacgttaccgttttccggggacgggttaaacggggaacccgtaaagggtacgggtaacgaaacgttaccgaaaacgggtacgtaaaccgtgggttaacggtaccgttcggaccctaaccggtaactttccggtttaccg

SEQ ID NO: 367802 - DNA, 601 bp, Homo sapiens
  misc_feature: GZ8MTXP02GRE1I.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggcgggcagtcaggatattaggcgctcggttaggctggtatcagcaagaaacgcgaacgggaaacccctaagcctcctgatctatggtgctatcctagtttggaaacggttcggggtacccctagtaacggttcccgacggtcggcgaggtggattcgtggggacaggtactttcacgtctcgacctatcacgcacgcctgacagactagtaagtactttgacttaacttttatttcgactaacgtacgtacccttaaccttacccctttccccgtacttaccggtttacgggaccgggtaacgggaaccgtaagggttcggaatacgtacgaaacgtcgtaaaccgtggtacgcgtacgacctacgtacttctgttccctttacg

SEQ ID NO: 367803 - DNA, 533 bp, Homo sapiens
  misc_feature: GZ8MTXP02FNX4Z.19.57.F02.1.454.CMB.2.raw
  modified_base (521)..(521): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatataggcgctcgttaggctggtatcagcagaaagcacgggaacccctagctcctgatctatggtgcatcccactttagggaaagtcggggtcccctcgaaggttccaggcggcagtggatcgtggacagatttcactctcgccatcagcagcctgcagactagaagtatttgactaactttatttacgtcaacaggtcctaacctacctttacccccctctaccgttacgggacgggtagggtaacccgaaggttggaagactacaaacgacgaactgtggctgaccaccntctcgtcttacc

SEQ ID NO: 367804 - DNA, 631 bp, Homo sapiens
  misc_feature: GZ8MTXP02IRFBW.19.57.F02.1.454.CMB.2.raw
  modified_base (197)..(197): a, c, t, g, unknown or other
  modified_base (240)..(240): a, c, t, g, unknown or other
  modified_base (301)..(301): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatattaggcgntcgttaggctggtatcagcagaaagccgaacgggaaccccctaagctcctgatctatggtnacactacctacgtttaggaaacggttcggggtcccctagtaaggttccaggcgctagtgatcgtgggacagtacttcactctcgcctatcagcacgcctgacagtactagtaaagtatttacgtacttaaactttttattttacgtacctaaacgacggttaaccttaaacccttacccttttacccccgtcgttaaccggttttccggggaacggggtaaacggggtaacccgtaaaggggttacggaaacgtacgttaaccgaaaacggtaccgtaaaacgttggtacggtaacgtcggtacctacctagttccttcgttacttaccg

SEQ ID NO: 367805 - DNA, 565 bp, Homo sapiens
  misc_feature: GZ8MTXP02G685E.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggatattaggcgctcgttaggctggtatcagcagaaagcgaacgggaaaccccctaagctcctgatctatggtgcatccactttggaaacgtcggggtccctcgaagttccagcgcagtggatcgtgggacaggatttcactctcgccatcagcagcctgcagactgaagtatttgactactttattttgactaaacagtactaacctacctttccccctacgtacgtttcgggacggtaagggaacccgtaaagggtacggtaagtataccgaaaggtacggaaaccttgggtacggcttcggacctaccctattcccggtttacgttaccttacg

SEQ ID NO: 367806 - DNA, 546 bp, Homo sapiens
  misc_feature: GZ8MTXP02HNVHY.19.57.F02.1.454.CMB.2.raw
  modified_base (359)..(359): a, c, t, g, unknown or other
  modified_base (380)..(380): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaaggatattaggcgctcgttaggctggtatcagcagaaagcaacgggaaacccctagactcctgatctatggtgcatccacgtttggaaacggtcggggtcccctgaacggttccgagcggcaggtggattcnggggacagtaatttcgactcncgccatcagcagccctgcagactagaagtatttgactaactttatttttcgtacaactacgggtactaacctacctttacccctcgtacgtttcggacggtacggaccgtaaacggtggagactacgaagaccgaaactgtacggctcgactacatctcttcttac

SEQ ID NO: 367807 - DNA, 608 bp, Homo sapiens
  misc_feature: GZ8MTXP02JQH2Q.19.57.F02.1.454.CMB.2.raw
  modified_base (305)..(305): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaaggattagttaggcgcgtcggttaggctggtatcagcaagaagcgaacggaaacccctagctctgatctagtggtncactccgtacgtttaggaaacggttccggggtacccctagtaacggttccgaggtcggacgtaggtggactcggtgggactaggtactttcactctcgcatcgagacacgcctgacagactagtaattagtttagtacttaactttattttacgactaacgtacggtaccttaaccgttaccctttccccgtacgttaccggtttccgggacgggtaacgggaccgtaaagggtcggaacggtaactacgaacggaccgtaaacgtggtacgtcgtcgaccaactcgtcttacgtctttaccg

SEQ ID NO: 367808 - DNA, 726 bp, Homo sapiens
  misc_feature: GZ8MTXP02FOECL.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcgagtcaggatagttaggcgctcggtaggctggtatcagcaagaaacgaccgaacgggaaaacccctaagcctacctagacttctagtggtcgctaactcccgtaacgtttagggtaaacggtccggggtacccctagtaacggttccgacggcggacgtaggtggtaacttcggtagggggtactacgttactttaccgaccttcgtaccgaccctactaccgacggaccgaacgtcccgttcgtaccgaacggtaaacctagggtaaatttaacgttttacgttaaacctttaaacctttttaagttttttacggaacctaaaacggtaaccggttaaccttaaaacccctttaccccttttacccccgtacgttacccgtttaccggggacgggtaaacggggaaacccgtaaggggtacggaaacggtactaacgtaaacggacccgtaaacgttcggtcggtaaccgtacgaccctactacttccggttcgttcctttaac

SEQ ID NO: 367809 - DNA, 650 bp, Homo sapiens
  misc_feature: GZ8MTXP02JOBY6.19.57.F02.1.454.CMB.2.raw
  modified_base (208)..(208): a, c, t, g, unknown or other
  modified_base (274)..(274): a, c, t, g, unknown or other
  modified_base (400)..(400): a, c, t, g, unknown or other
  modified_base (476)..(476): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatcgacccagtcctccattccttccgtgtctgctatctggtaagganacagagtccaacatcacgttggcgggcgagtcgaaggtatagtaggcgtctcggttaggctggtancgagactaagaagcgaaccggaaacccctagcctaccgtagacttacgtagtcggtacgactacgttcctaacggtttaggggaaacggtcccggggtacccctaggtaacggttcgaggccgganaggtgactgggaggactagtacttcacgtctacgacatcgagtcacgctgacgagacgttaggaactttacgtttnaaactttactttttagttacgtaacctaacgtacgtaacccttaacccgtttaaccctttccccgtacttaccggttcggaaccggggtacggaaccgtaaggggtaccgaagtacgtaaacgacggtcgaacgttcggcggtacctacgacctaaccggtgtttacccgttcc

SEQ ID NO: 367810 - DNA, 654 bp, Homo sapiens
  misc_feature: GZ8MTXP02GUK3D.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcacatcacttgtcgggcgagtcaggatagttaggcgctcgttaggctggtatcagcaagaagcgaacgggaacccctaagctcctgatctagtggtgcactcccgaacgtttgggaaacgtcggggtccccctagtaacggttccgaacggccggacgaggtcggattcgtgggggaactaggtactttcactctcgccatcagcacgcctgacagacgtagtaagtacgtttagacttaaactttattttcgtactaacgtacggtacctaaaccgttaccctttccccctacgtaccgtttccggggtacgggtaaacggggtaacccggtaaaggggtacggtaacggtaaacgttaccgaaacggtaaccgtaaaccgtttcgggtaacgggtcgttaccggaaccggtaaccccgtaagtttaccttcggtttaacctttacccg

SEQ ID NO: 367811 - DNA, 518 bp, Homo sapiens
  misc_feature: GZ8MTXP02JZZ82.19.57.F02.1.454.CMB.2.raw
  modified_base (440)..(440): a, c, t, g, unknown or other
tcagtactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatataggcgctcgttaggctggtatcagcagaagcaggaacccctagctcctgatctatggtgcatccagtttggaaagtcggggtcccctgaaggttccagcgcagtggatcgtgggacagtatttcactctcgcatcagcagcctgcagactgaagtatttgactaactttattttgacaacgtaggtacctaactacctttaccccctntaccgtttcggacggacggaccaacgggtggagactacgaacgcgaacgtgtaggctagcaccgtatctacgtcttac

SEQ ID NO: 367812 - DNA, 717 bp, Homo sapiens
  misc_feature: GZ8MTXP02HHURX.19.57.F02.1.454.CMB.2.raw
  modified_base (200)..(200): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccatccttccgtgtctgcatcgtgtagganacagacgtcaccatcacgttggcgggcgagtcgaggattagtaggcgtctcggttaggctggtatcgagcgaagaacgccgaaaccgggaaacccctagcctccgtgactctagtggtcgactactacccgtagtttagggaaacggttccggggtacccctagtaggttcccgaggtccgcgtaggtggacgttcggtcggggtaactagttacttccgtaccgtccgtaccgaccacgtcacgacacgtcctagacgtacgtaacgtagtaagtttacgtttacgtaaaccttttaccgtttttaagttttaccgtaaaccgtaacgttaccggttaaacccttaaccccgttaacccccgtttcccccttacggtttacccggtttaccgggggaccggggtaaacggtacccggttaaagggtacggtaacgtaacgtaccgtaaacggacggttaacgtcggttacggccgttacgaccgtaccttacgtccgtttacgttcctttaacccg

SEQ ID NO: 367813 - DNA, 870 bp, Homo sapiens
  misc_feature: GZ8MTXP02IJXGM.19.57.F02.1.454.CMB.2.raw
  modified_base (299)..(299): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcggcgagtcaggatataggcgctcgtaggctggtatcagcaagaaagcgaacggaaacccctagctcctgactctagtggtncactccgtacgttttagggaaacggttccggggtacccctacggtaacggtttcccgaggtaccggtcgtaaggtggtaacgttccggtaggggaactaagtacgtttttacccgaaccgtttccgtaccgtacccgtaaacttaccgaaaccggtaccgtaaccggtccccgttaggacccgtaaacgggtaaacccgtttaaagggttaaaacggtttaaacgtttttttaccgggaaacctttttaaaacccggtttttttaaagttttttttaaccgggttaaaacccgttaaaaccgggttaaccggggtttaaaaccccctttaaaaccccggtttaacccccctttttacccccccgtttaacgtttaaccccgggtttttacccgggggaacccgggggttaaaaccgggggtaaaacccccggttaaagggggttacggggtaaacggtaaccgttaaaccgggaaaaccggttaccgggtaaaaccgtttcgggtaccgggtaaccgtacggtaaccctaaaccggttacttccgtttaaccggtttccgtttaaaccccg

SEQ ID NO: 367814 - DNA, 820 bp, Homo sapiens
  misc_feature: GZ8MTXP02G7ZKD.19.57.F02.1.454.CMB.2.raw
  modified_base (199)..(199): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtcctccatcttccgtgtctgcatctgtagganacagagtccaccatcacgttggtcgggcgagtcgaggtattagttacggcgtcttcggttaggcgtaggtatcgagacaaggaaagcgaacgggaaaccccctaagcctaccgtagacttcgtaagttgggtacaccgtaactttcccgtaacggttttaacggggaaaacgggtttcccgggggttacccccctaaggttaaacgggttccccgtaacggggtcccggggtacgtaaggggtcggttaacgttcccggttaggggggaacctaacgggttaacttttacccgtaacccggtttcctacccggacccttacgtaccgaaacgtccgaaccggtcccgttaccggacgaacggtaaccgttaggtaaaacggttacttttacggtaaacccttaaacgttttttagttttaccggtaacctaaaaccgtaccgggttaaacccttaaaccccgtttacccccttttacccccgtaccgtttaaaccggtttccggggaacgggttaaccgggaaaccccggtaacggggttaggacgtaaccgtaaggaaaccggtacgtaaaccgtttgggacggtctcggacctaccgtattccgtacgttcctttaccg

SEQ ID NO: 367815 - DNA, 661 bp, Homo sapiens
  misc_feature: GZ8MTXP02GEJBB.19.57.F02.1.454.CMB.2.raw
  modified_base (263)..(263): a, c, t, g, unknown or other
  modified_base (314)..(314): a, c, t, g, unknown or other
  modified_base (645)..(645): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcgaggattagttaggcgtctcggttaggctggtancagcaagaaagacgaacgggaaaccccctagcctcctagactctagtggtnctatccgtacgtttagggaaacggtccggggtacccctagtaacggttccacggcggacgtaggtggattcgtggggactagtactttccacttcgtccgacctaagtcgacgcgacgtccgtagacacgtactaggtaaagttacttttacggtaacctttaaaccgtttttagtttacggttaacaaaccgttaacgggttacccttaaacccgttcccctttacccccgtcgttaaaccggtttcggggaccgggtaacgggtaaccggtaagggttacggatacgtaacgaacggtacgtaacgtcggtacggcttacgacctactnttccgtacgttcttac

SEQ ID NO: 367816 - DNA, 623 bp, Homo sapiens
  misc_feature: GZ8MTXP02IY29I.19.57.F02.1.454.CMB.2.raw
  modified_base (198)..(198): a, c, t, g, unknown or other
  modified_base (314)..(314): a, c, t, g, unknown or other
  modified_base (353)..(353): a, c, t, g, unknown or other
  modified_base (368)..(368): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccatcttccgtgtctgcatctgtagganacagagtcaccatcacgttggcgggcagtcaggtatagttaggcgtcgtcggttaggctggtatacgagacaagaaacgaccgaaccgggaaacccctagctccagtatcagtggncactacctagttaggaacgtcggtccctagtacgtccgngcgcgagtggatcgnggactagtacttcactcgcgacatcagcacgctagacacgacgtagtaagttactttacgaacctttaacgttttacgttttacgaacctaaaaccgtacggtaacccttaaaccttcccccgtttacccccgtacgttacccggtttacggggaccggggtaaacggaaccgtaaggggtacgtaacgacgtaacgaaacggtacgtaaccgtggtacggtcaccgtaccacgtacttcgttcttactttaccg

SEQ ID NO: 367817 - DNA, 591 bp, Homo sapiens
  misc_feature: GZ8MTXP02G3S27.19.57.F02.1.454.CMB.2.raw
  modified_base (201)..(201): a, c, t, g, unknown or other
  modified_base (303)..(303): a, c, t, g, unknown or other
  modified_base (314)..(314): a, c, t, g, unknown or other
  modified_base (423)..(423): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtccaccatcacgttggtcgggcagtcaggtatagttaggcgtcttcgttaggcttggtatcgagcaagaaagcgaacggaaaccccctagcctccngatctagtggnctacttcctacgtttaggaaacggtccggggttaccctacgtaaggttcaggacggcgaggttcggagtcgtagggactagtactttcgactcgtacgctactcagacngcctgacagtactagtaattagtttacaacttacgttttatttacgactaaacgtacgtaccttaaccttaccctttccctacgttacgttacggggacggtaacggtaccgtaaagggtcgaagtactacgaaagtcctaagtgtacggctagacctactctcttcg

SEQ ID NO: 367818 - DNA, 671 bp, Homo sapiens
  misc_feature: GZ8MTXP02GBMDT.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcgagtcaggattagttaaggcgcttcggttaggctggtatcagacagaaacgacgaacggaaacccctaagctcctgatactatggtcgctactaccgtacgtttagggaaacggttcggggtacccctagtacggttccgacgcggcgtaggtcggaagttcgtcggggactaaggtactttacgacctcgtcgcctaactccgacgcgacgtcctagacgtagaacgtagtaaagttactttacggtaacttaaacgtttttatttttcggtaactaaaccgtaaggtaacccttaaacccttacccttttaccccctcgttaaaccggtttccggggaacgggtaacggggtaacccgtaaagggggtacgtacggtaactacgaaacggtacgtaaacgtggttcggaacgttacggacctactacttccgtcgttcctttacccg

SEQ ID NO: 367819 - DNA, 644 bp, Homo sapiens
  misc_feature: GZ8MTXP02H6PCJ.19.57.F02.1.454.CMB.2.raw
  modified_base (197)..(197): a, c, t, g, unknown or other
  modified_base (223)..(223): a, c, t, g, unknown or other
  modified_base (299)..(299): a, c, t, g, unknown or other
  modified_base (415)..(415): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtccaccatcacttggtcggngagtcaggtatagtagcgctcgtaggctggtatcagacagaagacgaacggaacccctagctcctgatctatggtnacatccctagtttaggaaacgttcggggtcccctacgtaaggttccagccggacaggtgatcgtgggactagtacttcactcgtcgcatcagcagcctgacagtactagaacgttntttacgtacttaacttttagtttttcgactaacgtacggtacttaaacccttaccttacccccttcgtaccggttttccgggacgggtaaaccggggtaacccgtaaaggggttacgggaaacgttacgttaacccgaaaggttacccggtaaacgttacgggtaccggtccggttccggtaaacccgtaccgttaactttacccgtttacggtttcccctttaacccg

SEQ ID NO: 367820 - DNA, 552 bp, Homo sapiens
  misc_feature: GZ8MTXP02FXNYO.19.57.F02.1.454.CMB.2.raw
  modified_base (197)..(197): a, c, t, g, unknown or other
  modified_base (295)..(295): a, c, t, g, unknown or other
  modified_base (342)..(342): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcagtcaggatattaggcgctcgttaggctggtatcagcagaagcagggaaacccctaagctcctgatctatggtncatccactttgggaaacgtcggggtcccctacgaaggttccagcggnagtggatcgtggggacagtatttcacttctcgccatcagcagcctgcagactagaagtatttgacttaactttattttagtactaacgtaggtaccttaacctacctttaccccctcgttacgtttccgggacggacgggaccgaagggtcgaagacgtacgaacgacgtaaacgtgtacggcgtcgactacctatcgtacgttcttacg

SEQ ID NO: 367821 - DNA, 595 bp, Homo sapiens
  misc_feature: GZ8MTXP02G09MZ.19.57.F02.1.454.CMB.2.raw
  modified_base (197)..(197): a, c, t, g, unknown or other
  modified_base (286)..(286): a, c, t, g, unknown or other
  modified_base (296)..(296): a, c, t, g, unknown or other
  modified_base (338)..(338): a, c, t, g, unknown or other
  modified_base (347)..(347): a, c, t, g, unknown or other
  modified_base (373)..(373): a, c, t, g, unknown or other
  modified_base (388)..(388): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggcgggcgagtcaggatagttaggcgctcggtaggctggtatcagcagaagcgaacggaacccctagctcngatctatggncatcctagtttaggaacggtcgggtccctagaggtccagcgnagtgatcgngggacagtctttacgctcgtccgacngtacaggcacgtccngaccagtacgtagtaacgttatttacgaactttaacttttagttttacgtactaaagtacgttaccttaacccttacccctttaccccgtacttaccggttaccgggacgggtacgggaaccgtaggtacggagtaacgtaacggaacggaccgtaaacgtcggttacgcgtacggacctaacctagtttcttcggttctttaaccg

SEQ ID NO: 367822 - DNA, 756 bp, Homo sapiens
  misc_feature: GZ8MTXP02HD7F0.19.57.F02.1.454.CMB.2.raw
  modified_base (197)..(197): a, c, t, g, unknown or other
tcagtactctcgtgcacgaccggtgctcgatttagctcgatatagttgggtttggggagtcagacccagtcaggacacagcatggacatgagggtcccccgctcagctcctggggctcctgctgctctggttcccaggttccagatgcgacatccagatgacccagtctccatcttccgtgtctgcatctgtagganacagagtcacctatcacgttgtcgggcgagtcaaggtatagttaggccgtcgtcggtaggctggtatcagacaagaaagcgaacgggaaacccctaagcctcctagtactctaagtggtacgactattacccgtacgtttagggtaaaacggttccggggttacccccctagggtaaacgggttaccccgaaggtaccgggtacgtaagggttcgggtacttcgggttacgggggaacctaaggttaacctttttacccgaaaccgtttccgttacccggaccctaaacgttccaacggtacccaacgggtcccttagacgtaaacggtaaccttaagggaaacgttacgtttttacggaaactttaaactttttagttttacgtaaccgaaaacgtcggtaaacccttaaccttaacccccgtttccccctaagttacccggtttcggaccggggtaacggaaccgtaagggtaccggagtaacgtacgaaacggaccgtaaaccgttggtaccggtaacctggaaccctacgtaacttccgtacgtttccgtaaccg

SEQ ID NO: 367823 - DNA, 621 bp, Homo sapiens
  misc_feature: GZ8MTXP02IMHYF.19.57.F02.1.454.CMB.2.raw
  modified_base (310)..(310): a, c, t, g, unknown or other
  modified_base (430)..(430): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtccaccatcacttggcgggcagtcaggtatagttaggcgtctcgttaggctggtatcagacagaaagaccgaacgggaaaccccctagcctcctgtatctagtggtncactccgtagtttaggaaacggtccggggtcccctagtacggtccaggtcgcgaggtgagtcgtggggacagtacttcacctctcgcatcacgcacgcctagcacgtactgtaaacgttntttacgtactttaacttttatttacgtaccgtaacgtacggtacccttaacccctttcccctttacccctcgttacccggttcggggtaaccggtacgggtaccgtaagggtacgtaagacgtaacgaaacgtaccgtaagtcggtacggtaacctcgacctacgtactttaccgttacgttccttaaccg

SEQ ID NO: 367824 - DNA, 853 bp, Homo sapiens
  misc_feature: GZ8MTXP02IASB7.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcgaggtattagttaggcgtctcggttaggctggtatcgagacaagaaagcgaacggaaacccctagctcctgatctagtggtgactactaccgtacgttttagggaaaacggttccggggttaccccctacggtaaacgggtttccccgacgggtaccgggacgtaagggttcggggtaacgttccgggttagggggtaaactaacggttaccgtttttaccctaaccgtttcccgtacccgtaccctaaacgttccgaaacggtcccaacggtccccgttagacgtaacgtaacgttaacggtaaaggttttacgttttaacggaacctttttaaaacttttttacgttttttttaacgggaacccttaaaacggttaccgggttaaccctttaaaaacccgtttccccctttttaccccccgttaccgtttaacccgggtttttaccgggggaacccgggggttaaaacggggtaaaaccccggttaaagggggtaacgggtaaacggtaaaccgttaaccgggaaaacggtacccggttaaaccggttcggttaccgggggtaaccgtaccggtacccttaaaccggtacctttacccgttcggttttaacccctttaccccg

SEQ ID NO: 367825 - DNA, 586 bp, Homo sapiens
  misc_feature: GZ8MTXP02HRR26.19.57.F02.1.454.CMB.2.raw
  modified_base (361)..(361): a, c, t, g, unknown or other
  modified_base (365)..(365): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatagttaggcgctcgttaggctggtatcagcaagaagcaacgggaaacccctagctcctgatctatggtgcatcctacgtttggaaagtcggggtcccctgtaaggtccaggcgcaggtgatcgtgggganagtntttcactctcgccatcagcacgcctgcagactagtaagttattttgacttaaattttatttttgtactaacgtaggtacctaaacctaccctttcccctacgttaccgtttacgggacgggtaacgggacccgtaacggggtaggtaacgacgtaacgaaacggtacggaacgttggtcggtaacgtacggacctaccgtattccggttcttacgtttccc

SEQ ID NO: 367826 - DNA, 606 bp, Homo sapiens
  misc_feature: GZ8MTXP02F5T80.19.57.F02.1.454.CMB.2.raw
  modified_base (364)..(364): a, c, t, g, unknown or other
  modified_base (377)..(377): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgctcgtaggctggtatcagcagaaagcaacgggaaacccctagctctgatctagtggtcgctatcctacgtttaggaaacggtcggggtcccctacgtaacggttcaggcggcaggtggntcgtgggacagtnttcactctcgcatcagcagcctgacagtactagtaacgttattttacgacttaaacttttagtttttagactaaacgtacggtaccttaaaccttacccttttacccccgtactaccgtttcgggaccgggtaacgggaacccgtaaggggtacggaaacgtaacgttacgaaacggaccggtaaacgtcggtcggtacgttcggacctaacccgtctttaccgtttcg

SEQ ID NO: 367827 - DNA, 632 bp, Homo sapiens
  misc_feature: GZ8MTXP02HQK01.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcacatcacttggtcgggcgagtcaggtatagttaggcgtcgtcggttaggctggtatcgagcagaagcgaacggaacccctaagctcctgatctagtggtgctactcctacgtttaggaaacggtccggggtacccctgtaaggttccgaggcgacgaggtggtactcgtgggaacagtacttacactctcgacctatcgagcacgctgactagactagtaagttatttacgactttaaacgttttagttttacgtacaaaacgtacggtaaccttaaccttacccctttccccgtacgttaccggtttaccggggacgggtaacgggaaccgtaaggggtacggactaacggtaacgaaacggtaccggtaactcgggtacggtaacgtacggacctaccgttaactccgttacgttacccttaccg

SEQ ID NO: 367828 - DNA, 613 bp, Homo sapiens
  misc_feature: GZ8MTXP02JHPA8.19.57.F02.1.454.CMB.2.raw
  modified_base (181)..(181): a, c, t, g, unknown or other
  modified_base (197)..(197): a, c, t, g, unknown or other
  modified_base (302)..(302): a, c, t, g, unknown or other
  modified_base (314)..(314): a, c, t, g, unknown or other
tcagtactctcgtgcacgaccggtgctcgatttagctcgatatagttgggtttgggggagtcagacccagtcaggacacagcatggacatgagggtccccgatcagctcctggggctcctgctgctctggttcccaggttccagatgcgacatccagatgacccagtctccatcttccgtntctgcatctgtagganacagatcaccatcacgttggtcgggcgagtcaaggtattaagttagggcgcgtcggttaggcgttggtatcagcaagaaagcgaacgggaaaccccctagctccngtatctagtgtncatcctacgtttaggaaacgtcgggtccctagaggttccaggcgctagtggatcgtgggacagtactttcactcgtcgccatcagcacgctgacacgactagaagttatttatacttaaattttatttacgtactaacgtacggtaaccttaaccttacccctttaccccctcgtttacccgttacgggacgggtacgggaaaccgtaacgggtacgggtaaagtacgtacgaaacggtacgtaacggttacggtcggccgtacggtacctaccgtacttccgttcgtacctttacccg

SEQ ID NO: 367829 - DNA, 640 bp, Homo sapiens
  misc_feature: GZ8MTXP02JGLKT.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcgagtcaggatagttaggcgctcggttaggctggtatcagcaagaaagcgaacggaacccctagcctctagatctagtggtcgactactcccgtacgtttagggaaacggttccggggtacccctaggtaaacggttccgaacggtcgggacagggttcggaacgtcgtggggaactaggttaactttccacgtctcgacctatcgacgtcacgcctgactacgtaacgtagtaacttagtttacgtactttaaactttagtttacgtacctaacgtacggtaccttaaccgtaccctttaccccgtacgttaccgttcgggaaccgggtaacgggtaaccgtagggtacggacgtaacgtacgaacggtacgtaaacgtggtacggctacgacctacgtactcgttacgtcttacg

SEQ ID NO: 367830 - DNA, 818 bp, Homo sapiens
  misc_feature: GZ8MTXP02I7HZ9.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcgggcgagtcaggtatagttaggcgtcgttcggttaggcttaggtatcgagacaaggaaaagccgaaaccgggaaaccccctaagccttaccgtaggattccgtagtggtcgactacgttacccgtacgtttaagggtaaacgggttccggggtacccctaggtaaacgggttcccgaacgggtccgggtactaggggttacggtaacgttcggggtacgggggtaactaacgggttactttttcccaacccgtttccgtaccggtaccctaacgttaccgaaacggcccgtaacggtcccgttacgaccgtaacggttaaacgttaaggttaaaacggtttactttacggtaaacctttaaaacgttttttagtttttaaccgttaaccgtaaaaccgttaccgggttaaaccccttaaaccccgtttacccccgttttacccccgttaccggtttaaaccgggttttccggggaaccggggtaacggggtaaacccggttaaaggggtacggaaacgttacgtaaacgaacgggtacgttaaccgtggttacgaacgtccgtaaccgtacctacgttccttacgtttcctttacccg

SEQ ID NO: 367831 - DNA, 509 bp, Homo sapiens
  misc_feature: GZ8MTXP02FHIYN.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatctccgtgtctgcatctgtaggagacagagtcaccatcacttgtcgggcagtcaggatataggcgctcgttaggctggtatcagcagaaagcagggaaccccctaagctcctgatctatggtgcatccactttggaaagtcggggtcccctcgaaggttccagcggcagtggatcgtgggacagatttcactctcgccatcagcagcctgcagactagagtattttgctaacttattttgacaacaggactaaccacctttccccctctacttcggacggtacggaccgaacggtggagactacgaaagcgaactgtagctgcaccatctcgtcttc

SEQ ID NO: 367832 - DNA, 617 bp, Homo sapiens
  misc_feature: GZ8MTXP02FU2P4.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtccccatcttccgtgtctgcatctggtaggagacagagtcaccatcacttggtcgggcgagtcaggtatagttagggcgtctcggttaggctggtatcagcaagaaacgcgaacgggaaaccccctaagcctcctagatctagtggtgactatcctaacgtttaggaaacggttcggggtcccctagtaaggttcacgcggacaggtggatcgtagggactagtactttcgaccttctacgcatcgagcagcctgcagactagaagttatttagacttaacttttattttgtaactaacgtacgtaacctaaccttaacccctttcccctacgtaccgtttacggggacgggtaacgggtaaccggtaagggtacggagtaacgtacgaaacggtacgtaacgtaggtcggactaacggaccaacgtactcttacgttcttacgttacccg

SEQ ID NO: 367833 - DNA, 583 bp, Homo sapiens
  misc_feature: GZ8MTXP02FPZ4C.19.57.F02.1.454.CMB.2.raw
  modified_base (202)..(202): a, c, t, g, unknown or other
  modified_base (304)..(304): a, c, t, g, unknown or other
  modified_base (442)..(442): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccattcttccgtgtctgcatctgtagganacagagtcaccatcacttgcgggcagtcaggatagtaggcgcgtcgtagctggtatcagcaagaaagcgaacggaaacccctagctcctagatctagtggtncatcctagtttaggaaacgtcgggtaccctagaaggttcaggccggataggtgagtcgtaggggactagtactttacacgtctcgacctatcagcagtccagacagtactagtaagttatttacgactttaaactttntttacgtaacaacgtacgtaccttaacctcccttttcccccgagtaaccgtttcgggacgggtaacggtaaccgaaagggtcggaaatagtaccgaaaggtacaaaggttgtacggactacggacctaaccgtcttcgtac

SEQ ID NO: 367834 - DNA, 577 bp, Homo sapiens
  misc_feature: GZ8MTXP02JUK5Z.19.57.F02.1.454.CMB.2.raw
  modified_base (197)..(197): a, c, t, g, unknown or other
  modified_base (292)..(292): a, c, t, g, unknown or other
  modified_base (302)..(302): a, c, t, g, unknown or other
  modified_base (374)..(374): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcaggattagttaggcgctcggtaggctggtatcagcaagaagcgaacgggaaacccctagctccngatctatggncactcctacgtttagggaaaggtcggggtcccctagtaaggttccaggcggcaggtcggatcgtggggaacngtactttcactcgtcgccatcaagcacgccctgcagactagaagtatttacgacttaacttttatttagtaccaacgtaggtacctaaccttaccctttccccctacgtacgtttccgggacgggtacgggaaccgtaagggtacggagtacgtacgaacgtacgaacgtcggtagccgtagaccacgtatcgtcgtcttacc

SEQ ID NO: 367835 - DNA, 657 bp, Homo sapiens
  misc_feature: GZ8MTXP02GA8LZ.19.57.F02.1.454.CMB.2.raw
  modified_base (314)..(314): a, c, t, g, unknown or other
  modified_base (605)..(605): a, c, t, g, unknown or other
tcagtactctcgtgcacgaccggtgctcgatttagctcgatatagttgggtttgggggcaggagtcagacccagtcaggacacagcatggacatgagggtcccccgctcagctcctggggctcctgctgctctggttcccaggttccagatgcgacatccagatgacccagtctccatcttccgtgtctgcatctgtaggagacagagtcaccatcacgttggtcgggcgagtcaggattagttaggcgctcgttaggctggtatcagacaagaaagcgaacggaaaccccctaagcctcctgatctagtggtnctactcctagtttacggaaaggtccggggtacccctacgtaaggttcgaaggcggacgtaaggtcggtacgttcgaggggaacctagttactttaccaaccttccttaccgaccctaactcgaacggacaaccggtcctacggaccgtaagtaaccgtaagtaagtttaacgttttacgtaaacctttaaacgtttttagtttttactaaccgtaaacgtacgttaaccttaaaccttacccctttaccccgtacgtaccgtttcgggacggtaacggaaccgttaaaggnggaacgtactacgaacgctaaacgtggtacgtcgacgtaccactactcttcg

SEQ ID NO: 367836 - DNA, 623 bp, Homo sapiens
  misc_feature: GZ8MTXP02I35GO.19.57.F02.1.454.CMB.2.raw
  modified_base (197)..(197): a, c, t, g, unknown or other
  modified_base (300)..(300): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaggatagttaggcgctcgttaggctggtatcagcagaaagcacggaaacccctaagctcctgagtctatggtncatcctattggaaagtcgggtcccctagtacggtccagcgcaggtgacgtcgtggggacagtactttacaccttcgtcgacccatcgacgcaacggcctgacacggaacgttagtaaacgttattttggtaaccttaaacgtttttagttttacggtaacaaacggtacggttaccttaaaacctcccgtttaccccctacgttaaccgtttcgggacgggaacggtaccgtaaagggttcgaaagttacgaacgaacggtaccgtaaacgttggtacggtaacgtccgaacgtaccctacggtttctacggttctttacccg

SEQ ID NO: 367837 - DNA, 652 bp, Homo sapiens
  misc_feature: GZ8MTXP02H7X46.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagatcaccatcacgttggtcgggcgagtcaggtattagttaggcgtcgtcgttaggctggtatcagcaagaagcgaacggaacccctagctctgatctagtggtgcactcctacgtttaggaaacggttccggggtcccctagtacggttaccgaggccggtacaggttggacgttcgtggggacctaagtactttaccaccttcgccgtaccatcagcacggtcctagacacgtaacgtagtaaacgtattttacgactttaaactttttagttttacgtaccaaacgtacggtaccttaaacccttaccctttccccctacgttaaccggtttcgggacgggtaaacgggtaacccgtaaaggggtcggtaaacgtacgtaacgaacggttaccgaacggtttcggacggtcttacgaacctacgtacgttcctttacgttccctttaccg

SEQ ID NO: 367838 - DNA, 620 bp, Homo sapiens
  misc_feature: GZ8MTXP02FUOWI.19.57.F02.1.454.CMB.2.raw
  modified_base (290)..(290): a, c, t, g, unknown or other
  modified_base (361)..(361): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatagttaggcgctcgttaggctggtatcagcaagaaagcgaacggaaacccctagctacngatctatggtgctactaccgtacgtttagggaaacgtccggggtacccctagtaacggttccacggccggnacggtggacttcgtgggacagtatttccactctccgactatcagcacgcctgacaggtactagtaagttatttgtaacttaaacttttagttttacgactaaacgtacggtaaccttaaacccttccctttaccccctcgttaaccgtttccgggaacgggtaaacggggtaaccgtaagggtacggaagtaacgtaaccgaaaggaccgttaaacgtggttcggaactcgacctacctattcgttacgttctttaccg

SEQ ID NO: 367839 - DNA, 592 bp, Homo sapiens
  misc_feature: GZ8MTXP02JMNXO.19.57.F02.1.454.CMB.2.raw
  modified_base (197)..(197): a, c, t, g, unknown or other
  modified_base (288)..(288): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcagtcaggatagtaggcgctcgtaggctggtatcagcaagaagcgaacgggaacccctaagctccngatctagtggtgcatcctacgtttaggaaacgtcggggtcccctagtaaggttccgaggcggctaggtggatcgtggggactagtacttccactcgtcgcctatcgacgtcacgccgtagacagacgtaggaagttatttgaacttaacttttagttttgtaaccaaacgtacggtaaccttaacttaccctttaccccctacttaccggtttcgggacggtaacgggaaccgtaagggtcggtaagacgtacgaacgtaccgtaacgtggagtccgtacgaccaacgtctcgttcgtctttac

SEQ ID NO: 367840 - DNA, 606 bp, Homo sapiens
  misc_feature: GZ8MTXP02H2V5B.19.57.F02.1.454.CMB.2.raw
  modified_base (196)..(196): a, c, t, g, unknown or other
  modified_base (300)..(300): a, c, t, g, unknown or other
  modified_base (374)..(374): a, c, t, g, unknown or other
tcagtactctcgtgcacgaccggtgctcgatttagctcgatatagttgggtttggggagtcagacccagtcaggacacagcatggacatgagggtcccccgctcagctcctggggctcctgctgctctggttcccaggttccagatgcgacatccagatgacccagtctccatcttcgtgtctgcatctgtagganacagatcacatcacttggtcgggcagtcaggtatagttaggcgctcgtaggctggtatcagcaagaaagcgaacgggaaacccctaagctcctgatctatggtncatcctagtttaggaagtcggggtccctagaggttccagcggcgagtggagtcgtggactagtactttcactcncgacatcagcagcctgacagactagaagttatttacgacttaacttttattttcgtaactaaacgtacggtaccttaaactaccccgtttcccccttagtaccgtttcgggaccgggtaacgggtaaccggaaagggttacggaagtaaacgtaccgaaaacggaccgtaaacgttcggttaacggtccgtcgtaacccgtacctaacttccgttaacgtttcctttacccg

SEQ ID NO: 367841 - DNA, 688 bp, Homo sapiens
  misc_feature: GZ8MTXP02GY9ZS.19.57.F02.1.454.CMB.2.raw
  modified_base (202)..(202): a, c, t, g, unknown or other
  modified_base (319)..(319): a, c, t, g, unknown or other
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccattcttccgtgtctgcatctgtagganacagagtcaccatcacgttggtcgggcgagtcgaaggtattagttaggcgtcgttcggtaggctggtatcgagacaagaaacgcgaacggaacccctagcctcagatctagtggtcnctactcctagtttaggaaacggttccggggtaccctacgtaacggttacgacggccggacgtaggttcggacgtcggtaggggaacctagttactttccaacgtcctaccgcctactaccgaacgccgaacgtcccgtacggaaccgaacggtacgtaaggtaaagtttacgttttacggtaaacctttaaactttttagttttacgtaaaccgtaaacgtaaccggttaaccttaaaccccgtttaccctttcccccgttacgttacccggttttaccgggaccgggtaacggtaaccggtaaagggtcggaaacgtacgacgtaacgacgtaagtccccggagtccgtacgacctactacttcgtcg

SEQ ID NO: 367842 - DNA, 757 bp, Homo sapiens
  misc_feature: GZ8MTXP02GL1P5.19.57.F02.1.454.CMB.2.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccattcttccgtgtctgcatctgtaggagacagagtcaccatcacttggtcgggcgagtcaggtattattaggcgtcgtcgttaggctggtatcagacgaagaaagacgaacgggaaacccctaagcctctagtactactaagttggtacgacctacttacccgtaacggttttacggggtaaaacggttccggggtacccccttacggtaaacgggtttccgaaacgggtccgggacgtaacgggttagggtacgtttccgggtacgggggtaacctaaaggttaccttttaccaaccgtttaccctccggtacccaaacttcccgaaaggtcccaaaccgggttccccgtacgaaccgtaacgtaaccgttaagttaaacgtttacgttttacgtaaactttaaactttttagttttacgaaccttaaaccgtaccgttaaccttaaaccctttacccctttacccccgttacgttacccggtttaccggggaacgggtaaaccgggtacgtaagggtacggaaacgtacgaacgtaacggtacgtaacgtggtacgacgtacgaccactacgtactttacg

SEQ ID NO: 367843 - DNA, 652 bp, Homo sapiens
  misc_feature: GZ8MTXP02GMKWM.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcagttggtcgggcagtcaggtatattaggcgtctcggttaggctggtatcagcaagaaagcgaacggaaaccccctaagcctcctgatctagtggtgctatccgtacgtttagggaaacggttcggggtacccctagtaaggttcccaggtcggacgtaggtcggacgtcgtggggactaggtactttaccgacctctccgacctatcgaacgcgacgtccgtagacgacgtacgtagtaagtttatttacgaaactttaacttttagttttacgaacgtaacgtacgtacccttaaacccttacccctttcccgtacgttacggtttcgggacggtaacgggtaaccgtaagggtacgaagtacgtaaacggacggtaaccgttaacgtcggtacggtctaccggaccttaacgtcgtttaccgtactttacctttacccg

SEQ ID NO: 367844 - DNA, 810 bp, Homo sapiens
  misc_feature: GZ8MTXP02GRQV3.19.57.F02.1.454.CMB.2.raw
  modified_base (197)..(197): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgttggtcgggcgagtcaaggatagttaggcgtctcgttaggctggtatcagcaagaaagccgaacgggaaacccctagcctctgtatcgtagtgtcgctactcgtacgtttaggaaacggttccggggtacccctacggtaaggttacccgaggccggactaggtacggtaacgttccggtaggggtaactacggtactttacctaaccgttccgaccgtaccctaacttccgaaacgccgaaacgtcccgttaggaaccgaagtaaaccgttaaggtaaaacgtttaggttttacgtaaacccttttaaactttttttagtttttaacccggaactaaaaacccggtacggtttaaaccccttaaaaccccccgttttacccctttttaacccccccggtacgttttaaacccggggtttaccccgggggaacgggggtaaaacccggggtaaaacccggtaaaacgggggtttgggaaaaccggttaccgttaaaccggaaaacgggtaccgtaaaaccgtttggggttaacgggccttcccgggtaaaccgtacccgttaaactttccggtttaccgttacctttttaaccccg

SEQ ID NO: 367845 - DNA, 777 bp, Homo sapiens
  misc_feature: GZ8MTXP02IS86I.19.57.F02.1.454.CMB.2.raw
  modified_base (197)..(197): a, c, t, g, unknown or other
  modified_base (317)..(317): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacgtttgcgggcgtagtcaggtatagttaggcgctcggtggtactggtatcagacaagaacgacgaacgggaaaccccctaaggctaccgtgtactcttagtggtnaccacttacccgtaacgtttagggaaacggtccggggttacccccctaagtaacgggttaccacggtaccgggacgtacgggtgggtaaccttcgggttacgggggtacctaaggttacttttacccgtacccttaccggtacccgtccccgtaaattcccgaaaggtcccaaaccggtacccgtttcgacccgaaagggtaaccgttaaacggtaaacgggttatttttaacggaaaccgtttttaaaactttttacggttttttaaacggtaacctaaaaccggttaaccgggtaaccccttaaaacccgtttccccgttttaccccccttacggttaaaaccccgttttcgggggaaaccgggttaacgggacccggttaaggtacggtaggtactaaacgtacggacgtaacgtggttacggctcgtacaaccttagttccgttacgtacctttcg

SEQ ID NO: 367846 - DNA, 591 bp, Homo sapiens
  misc_feature: GZ8MTXP02FHB87.19.57.F02.1.454.CMB.2.raw
  modified_base (256)..(256): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatctccgtgtctgcatctgtaggagacagagtcaccatcacttggtcgggcagtcaggatagttaggcgctcgttaggctggtancagcagaaagcaacgggaaacccctagctcctgatctatggtgcatcccacgtttagggaaacggttcggggtacccctcgtaaggttccaggtcggcgagtggatcgtgggacagtatttcactctcgctatcgagcacgcctgcagactagaagtattttcgacttaactttatttttacgacaacgtaacggtaccttaaaccctaccctttacccccgtacgttaccggtttacgggacgggtaacggggaaccaagggttcggaagtactacgaaacggtcgtaaccgtggtacggtctcggacctaccgtatccgtcgttcctttaccg

SEQ ID NO: 367847 - DNA, 751 bp, Homo sapiens
  misc_feature: GZ8MTXP02FNJ86.19.57.F02.1.454.CMB.2.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatccacgttggtcggcgagtcaggtattagttaggcgtcgtcggttaggcttggtatcagcaagaaagcgaacggaaaccccctaagctcctgactctagtgtgctatacctacgttaggaaagttccggggtacccctacgtaaggttccgaacggtccggacgtagggtaggtacgttacggtcggggaaacctaaggttactttcctaaccgttcgtcccgaccctaataccgaaacggctaaccgcccttagaccaacggtaactaaggtaaagttacgtttaacgtaacctttaaactttttaacgttttcggtaacctaaacggttaacggtaacccttaaacccgtttaccccgtttttaccccccctagttacccggtttacccggggtaacggggaacggggttaaacccggtaaaagggggttcggaaaggttaacgaaaccggttaaacggacccggtttaaaaccggtgggttacgggtaacccgtacgtaaccgtacccgtacgtttacgttaccgtttacctttacccg

SEQ ID NO: 367848 - DNA, 584 bp, Homo sapiens
  misc_feature: GZ8MTXP02JNKH1.19.57.F02.1.454.CMB.2.raw
  modified_base (204)..(204): a, c, t, g, unknown or other
  modified_base (241)..(241): a, c, t, g, unknown or other
  modified_base (556)..(556): a, c, t, g, unknown or other
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtcctcatcttccgtgtctgcatctggtaaggagacagngtcaccatcacgttgcgggcagtcaggatagttaggngctcgttaggctggtatcagcaagaaagccaacgggaaacccctagcctcctgactctatggtcgcatccctagtttacggaaacggttccggggtcccctagtaacggttccgagcggacaggtggacgtcgtgggaaccaggtactttcaactcgtctcactcagcctagcctgacacgacgtagaaagttactttaaatactttatttgactaacgtagtacctaaacctcctttaccccgtacttaccgttcgggcggtaacgggacgaaaggtggacgagtacgaacgttcgaacgttcgaaggtcgaanacgtactactcgttacctactcttaccg
